(12) United States Patent
Bernett et al.

(10) Patent No.: US 10,227,411 B2
(45) Date of Patent: Mar. 12, 2019

(54) MODULATION OF T CELLS WITH BISPECIFIC ANTIBODIES AND FC FUSIONS

(71) Applicant: Xencor, Inc., Monrovia, CA (US)

(72) Inventors: Matthew Bernett, Monrovia, CA (US); Seung Chu, Cypress, CA (US); Dilki Wickramarachichi, Pasadena, CA (US); John Desjarlais, Pasadena, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

(21) Appl. No.: 15/063,441

(22) Filed: Mar. 7, 2016

(65) Prior Publication Data

US 2017/0037131 A1 Feb. 9, 2017

Related U.S. Application Data

(60) Provisional application No. 62/128,843, filed on Mar. 5, 2015.

(51) Int. Cl.
| | |
|---|---|
| *C07K 16/00* | (2006.01) |
| *C07K 16/28* | (2006.01) |
| *A61K 39/00* | (2006.01) |

(52) U.S. Cl.
CPC ...... *C07K 16/2812* (2013.01); *C07K 16/2818* (2013.01); *C07K 16/2866* (2013.01); *A61K 2039/505* (2013.01); *C07K 2317/30* (2013.01); *C07K 2317/31* (2013.01); *C07K 2317/52* (2013.01); *C07K 2317/56* (2013.01); *C07K 2317/565* (2013.01); *C07K 2317/622* (2013.01)

(58) Field of Classification Search
None
See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 5/1982 | Hasegawa et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |

(Continued)

FOREIGN PATENT DOCUMENTS

| | | |
|---|---|---|
| EP | 0425235 B1 | 9/1996 |
| EP | 1752471 | 2/2007 |

(Continued)

OTHER PUBLICATIONS

Muramatsu et al (Cancer Letters, 2005, 225: 225-236).*

(Continued)

*Primary Examiner* — Sean E Aeder
(74) *Attorney, Agent, or Firm* — Robin M. Silva; Louis T. Nguyen; Morgan, Lewis & Bockius, LLP

(57) ABSTRACT

The present invention relates to methods and compositions for modulating T cells. The modulation includes suppressing or inducing regulatory T cells or cytotoxic T cells.

7 Claims, 251 Drawing Sheets

Specification includes a Sequence Listing.

(56) References Cited

U.S. PATENT DOCUMENTS

| | | |
|---|---|---|
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Meteo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 9,822,181 B2 | 11/2017 | Bonvini et al. |
| 9,856,327 B2 | 1/2018 | Bernett et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winekl |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Senter |
| 2010/0004431 A1* | 1/2010 | Bernett ............... C07K 16/00 530/387.9 |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Senter |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0336981 A1 | 12/2013 | de Kruif et al. |
| 2014/0024111 A1 | 1/2014 | Kannan et al. |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |

(56) References Cited

U.S. PATENT DOCUMENTS

| | | |
|---|---|---|
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2017/0020963 A1 | 1/2017 | Qu et al. |

FOREIGN PATENT DOCUMENTS

| | | |
|---|---|---|
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| EP | 3252078 | 12/2017 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007005612 | 1/2007 |
| WO | WO2007018431 A2 | 2/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO2007147901 | 12/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011063348 | 5/2011 |
| WO | WO2011066501 | 6/2011 |
| WO | WO2011131746 | 10/2011 |
| WO | WO2011133886 | 10/2011 |
| WO | WO2011143545 | 11/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013180201 | 12/2013 |
| WO | WO2014004586 | 1/2014 |
| WO | WO2014012085 | 1/2014 |
| WO | WO2014047231 | 3/2014 |

(56) References Cited

FOREIGN PATENT DOCUMENTS

| WO | WO2014056783 | 4/2014 |
|---|---|---|
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015103072 | 7/2015 |
| WO | WO2015143079 | 9/2015 |
| WO | WO2015149077 | 10/2015 |
| WO | WO2015184207 | 12/2015 |
| WO | WO2016014984 | 1/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016141387 | 9/2016 |
| WO | WO2016182751 | 11/2016 |
| WO | WO2017112775 | 6/2017 |

OTHER PUBLICATIONS

Sforzini et al (British Journal of Haematology, 1998, 102: 1061-1068).*
U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the Internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Aplin et al., Preparation, properties, and applications of carbohydrate conjugates of proteins and lipids, 1981, CRC Crit. Rev. Biochem., pp. 259-306.
Arnett, et al., Crystal structure of a human CD3-ϵ/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.

Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91.3809-3813.
Bargou et al., Tumor Regression in Cancer Patients by Very Low Doses of a T Cell-Engaging Antibody, Science, 2008, vol. 321, pp. 974-977.
Bhatt, Sea Lane—DDD presentation, "Surrobodies™—A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.
Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optimizing anti-CD3 affinity for effective T cell targeting against tumor cells.", Eur J Immunol. Nov. 2002;32(11):3102-7.
Boswell et al., Effects of Charge on Antibody Tissue Distribution and Pharmacokinetics, 2010, Bioconjugate Chem, 21(21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann , et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.

(56) References Cited

OTHER PUBLICATIONS

Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chothia et al., Canonical structures for the hypervariable regions of immunoglobulins, 1987, J. Mol. Biol. 196:901-917.
Chothia, et al., Structural Determinants in the Sequences of Immunoglobulin Variable Domain, J. Mol. Biol., 1998, vol. 278, pp. 457-479.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011. 11.029. Epub Jan. 16, 2012.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol. , 2005, vol. 350, pp. 112-125.
Counterman et al., "vols. Of Individual Amino Acid Residues in Gas-Phase Peptide Ions.", J. Am. Chem. Soc., 1999,121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
d'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 Cho production cell line: expression of antibodies with altered glycoforms leads to an increase in ADCC through higher affinity for FCγRIII, 2001, Biotechnol Bioeng 74:288-294.
Davila, et al., Efficacy and Toxicity Management of 19-28z Car T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (Seed) $C_H3$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization of Therapeutic Proteins by T-Cell Epitope Modification, 2005, Dev. In Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) complex in the initiation of inflammatory arthritis., J Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273288, May 1, 2011.
Doronina , Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3—Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7) , pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$, 1978, Biochem. Biophys. Res. Commun. 80(4):849-57.
Francois, et al., Construction of a Bispecific Antibody Reacting with the α-and ß-Chains of the Human IL-2 Receptor, The Journal of Immunology, May 15, 1993, vol. 150, No. 10, pp. 4610-4619.

(56) References Cited

OTHER PUBLICATIONS

F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate."
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_{L^-}$ and $V_{L^-}$ Segments in the Preferential Reassociation of Immunoglobulin Subunits, Molecular Immunology, 1986, vol. 23, No. 5, pp. 503-510.
HAwkins et al, Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.

Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered . bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, $5^{th}$ Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.
Kettleborough et al., Humanization of a mouse monoclonal antibody by CDR-grafting: the importance of framework residues on loop conformation, 1991, Protein Eng. 4(7):773-83.

(56) References Cited

OTHER PUBLICATIONS

Keyna, et al., Surrogate Light Chain-Dependent Selection of Ig Heavy Chain V Regions, J. Immunol., 1995, vol. 155, pp. 5536-5542.
Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kipriyanov, et al., Bispecific CD3 x CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell—engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell—engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.
Labrijn, et al., Efficient generation of stable bispecific IgG1 by controlled Fab-arm exchange, www.pnas.org/cgi/doi/10.1073/pnas.1220145110 & Supporting Information.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Ling, et al., Interspecies Scaling of Therapeutic Monoclonal Antibodies: Initial Look, J Clin Pharmacol, 2009, vol. 49, pp. 1382-1402, doi: 10.1177/0091270009337134.
Link, et al., Production and Characterization of a Bispecific IgG Capable of Inducing T-Cell-Mediated Lysis of Malignant B Cells, Blood, 1993, vol. 81, No. 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.
Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.
Liu et al., Eradication of large colon tumor xenografts by targeted delivery of maytansinoids, 1996 Proc. Natl. Acad. Sci. USA 93:8618-8623.
Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.
Lode et al., Targeted therapy with a novel enediyene antibiotic calicheamicins $o^{I}_{1}$ effectively suppress growth and dissemination of liver metastases in a syngeneic model of murine neuroblastoma, 1998, Cancer Res. 58:2928.
Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.
Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.
Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.
Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.
Ma, et al., Expression and Characterization of a Divalent Chimeric Anti-Human CD3 Single Chain Antibody, Scand.J.Immunol, 1996, vol. 43, pp. 134-139.
Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.

(56) References Cited

OTHER PUBLICATIONS

Mabry, et al., Engineering of stable bispecific antibodies targeting IL-17A and IL-23, Protein Engineering, Design & Selection, 2009, vol. 23, No. 3, pp. 115-127; doi:10.1093/proteinigzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.

Mandler et al., Modifications in synthesis strategy improve the yield and efficacy of geldanamycin-herceptin immunoconjugates, 2002, Bioconjugate Chem. 13:786-791).

Mandler et al., Synthesis and evaluation of antiproliferative activity of a geldanaymcin-herceptin™ immunoconjugates, 2000, Bioorganic & Med. Chem. Letters 10:1025-1028.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Marks et al., By-passing immunization: building high affinity human antibodies by chain shuffling, 1992, Biotechnology 10:779-783.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecific antibodies for dual-modality cancer therapy: killing two signaling cascades with one stone, Curr Opin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

Mateo et al, Humanization of a mouse nonclonal antibody that blocks the epidermal growth factor receptor: recovery of antagonistic activity, 1997, Immunotechnology, 3(1):71-81.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

Mertens, Nico, "Tribodies: Fab-scFv fusion proteins as a platform to create multi-functional pharmaceuticals.", SpringerLink 2011, 135-149.

Metz, et al., Bispecifc antibody derivatives with restricted binding functionalities that are activated by proteolytic processing, Protein Engineering, Design & Selection, 2012, vol. 25, No. 10, pp. 571-580.

Metz, et al., Bispecific digoxigenin-binding antibodies for targeted payload delivery, PNAS, 2011, vol. 108, No. 20, pp. 8194-8199.

Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.

Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.

Miller et al., Stability engineering of scFvs for the development of bispecific and multivalent antibodies, PEDS, 2010, vol. 23, No. 7, pp. 549-557 & Supplementary Data.

Miller, biogen idec Stability Engineering and Production of IgG-like Bispecifc Antibodies, AAPS National Biotechnology Conference, Jun. 24 to Jun. 27, 2007.

Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".

Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.

Mimoto, et al., Novel asymmetrically engineered antibody Fc variant with superior FcγR binding affinity and specificity compared with afucosylated Fc variant, mAbs, 2013, vol. 5, Issue 2, pp. 229-236.

Modjtahedi et al, Phase I trial and tumour localization of the anti-EGFR monoclonal antibody ICR62 in head and neck or lung cancer, 1996, Br J Cancer, 73(2):228-35.

Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.

Modjtahedi et al., Antitumor activity of combinations of antibodies directed against different epitopes on the extracellular domain of the human EGF receptor, 1993, J. Cell Biophys. 1993, 22(1-3):129-46.

Modjtahedi et al., The human EGF receptor as a target for cancer therapy: six new rat mAbs against the receptor on the breast carcinoma MDA-MB 468, 1993, Br J Cancer. 1993, 67(2):247-53.

Mølhøj, et al., CD19-/CD3-bispecific antibody of the BiTE class is far superior to tandem diabody with respect to redirected tumor cell lysis, Molecular Immunology 2007, vol. 44 , pp. 1935-1943.

Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.

Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.

Moore, et al., Application of dual affinity retargeting molecules to achieve optimal redirected T-cell killing of B-cell lymphoma, Blood, 2011, vol. 117, No. 17, pp. 4542-4551.

Moretti et al., BEAT® the bispecific challenge: a novel and efficient platform for the expression of bispecific IgGs. BMC Proceedings 2013 7(Suppl 6):O9.

Morrison, et al., News and Views: Two heads are better than one, Nature Biotechnology, 2007, vol. 25, No. 11, pp. 1233-1234.

Mosmann, 1983, Rapid colorimetric assay for cellular growth and survival: application to proliferation and cytotoxicity assays, J. Immunol. Methods 65:55-63.

Muda, et al., Therapeutic assessment of SEED: a new engineered antibody platform designed to generate mono and bispecific antibodies, Protein Engineering, Design & Selection, 2011, vol. 24, No. 5, pp. 447-454.

Murthy et al., Binding of an antagonistic monoclonal antibody to an intact and fragmented EGF-receptor polypeptide, 1987, Arch Biochem Biophys. 252(2):549-60.

Nagorsen, et al., Blinatumomab: A historical perspective, Pharmacology & Therapeutics, 2012, vol. 136, pp. 334-342, http://dx.doi.org/10.1016/j.pharmthera.2012.07.013.

Nelson, et al., Point of View: Antibody fragments—Hope and hype, mAbs, 2010, vol. 2, Issue 1, pp. 77-83.

Neville et al., Enhancement of immunotoxin efficacy by acid-cleavable cross-ling agents utilizing diphtheria toxin and toxin mutants, 1989, Biol. Chem. 264:14653-14661.

(56) References Cited

OTHER PUBLICATIONS

Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (−)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein-Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95:8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).

Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3- Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.

(56) References Cited

OTHER PUBLICATIONS

Schoonjans, et al., Fab Chains as an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp. 76-136, 1965, Academic Press.
Senter et al, Proceedings of the American Association for Cancer Research, 2004, vol. 45, Abstract No. 623.
Senter, Potent antibody drug conjugates for cancer therapy, 2009, Current Opin. Chem. Biol. 13:235.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human α/ß T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-284.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shields et al., Lack of fucose on human IgG1 N-linked oligosaccharide improves binding to human FcγRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.
Spiess, et al., Bispecific antibodies with natural architecture produced by co-culture of bacteria expressing two distinct half-antibodies, Nature Biotechnology, 2013, doi:10.1038/nbt.2621 & Supplemental Information.
Stamova, Unexpected recombinations in single chain bispecific anti-CD3-anti-CD33 antibodies can be avoided by a novel linker module, Oct. 29, 2011.
Stanfield, et al., Maturation of Shark Single-domain (IgNAR) Antibodies: Evidence for Induced-fit Binding, J. Mol. Biol., 2007, vol. 367, pp. 358-372.
Stewart, et al., Recombinant CD36 inhibits oxLDL-induced ICAM-1-dependent monocyte adhesion., Mol Immunol. Feb. 2006;43(3):255-67.
Strop, P. et al., Generating Bispecific Human IgG1 and IgG2 Antibodies from Any Antibody Pair, J. Mol. Biol., 2012, doi:10.1016/j.jmb.2012.04.020.
Tan et al., "Superhumanized" antibodies: reduction of immunogenic potential by complementarity-determining region grafting with human germline sequences: application to an anti-CD28, 2002, J. Immunol. 169:1119-1125.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.
Teachey, et al., Cytokine release syndrome after blinatumomab treatment related to abnormal macrophage activation and ameliorated with cytokine-directed therapy, Blood, 2013, vol. 121, No. 26, pp. 5154-5157.
Tedgui, et al., Cytokines in atherosclerosis: pathogenic and regulatory pathways., Physiol Rev. Apr. 2006;86(2):515-81.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.
Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JC165861. Epub Apr. 24, 2013.
Tomlinson et. al., Methods for generating multivalent and bispecific antibody fragments, 2000, Methods Enzymol. 326:461-479.
Topp, et al., Targeted Therapy With the T-Cell—Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
Van Boxel, et al., Some lessons from the systematic production and structural analysis of soluble αβ T-cell receptors, Journal of Immunological Methods, 2009, vol. 350, pp. 14-21.
Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.

(56) References Cited

OTHER PUBLICATIONS

Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.
Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6 , No. 8, pp. 989-995.
Wong, et al., The Mechanism of Anti-CD3 Monoclonal Antibodies, Transplantation, 1990, vol. 50, No. 4, pp. 683-689.
Woods, et al., LC-MS characterization and purity assessment of a prototype bispecific antibody, mAbs, 2013, vol. 5, Issue 5, pp. 711-722, http://dx.doi.org/10.4161/mabs.25488.
Woyke et al., In vitro activities and postantifungal effects of the potent dolastation 10 derivative auristatin PHE, 2001, Antimicrob. Agents and Chemother. 45(12):3580-3584.
Wu et al, Molecular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.
Wu et al, Simultaneous targeting of multiple disease mediators by a dual-variable-domain immunoglobulin, (DVD-Ig™) molecules, Jul.-Aug. 2009; 339-347, Oct. 14, 2007.
Wu et al., Humanization of a murine monoclonal antibody by simultaneous optimization of framework and CDR residues, 1999, J. Mol. Biol. 294:151-162.
Wu, et al., Multimerization of a chimeric anti-CD20 single-chain Fv-Fc fusion protein is mediated through variable domain exchange, Protein Engineering, 2001, vol. 14, No. 12, pp. 1025-1033.
Wucherpfennig, et al., Structural Biology of the T-cell Receptor: Insights into Receptor Assembly, Ligand Recognition, and Initiation of Signaling, Cold Spring Harb Perspect Biol 2010;2:a005140.
Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.
Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.
Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zamyatnin AA., Amino acid, peptide, and protein volume in solution., Annu Rev Biophys Bioeng. 1984;13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.
Zeibig et al., Effect of the oxLDL Binding Protein Fc-CD68 on Plaque Extension and Vulnerability in Atherosclerosis., Circulation Research 108: 695-703, 2011.
Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.
Zhu, et al., Remodeling domain interfaces to enhance heterodimer formation, Protein Science, 1997, vol. 6, pp. 781-788.
Zuo, et al., An efficient route to the production of an IgG-like bispecific antibody, Protein Engineering, 2000, vol. 13, No. 5, pp. 361-367.
Szymkowski et al., Creating the next generation of protein therapeutics through rational drug design, Current opinion in drug discovery & development, Sep. 1, 2005, p. 590, XP055354917, England.
Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-19258.
Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.
Wigginton et al., An immunoglobulin E-reactive chimeric human immunoglobulin G1 anti-idiotype inhibits basophil degranulation through cross-linking of FcεRI with FcγRIIb., Clinical & Experimental Allergy, 38:313-319.
Zalevsky et al. "Enhanced antibody half-life improves in vivo activity." Nature Biotechnology, vol. 28, No. 2, Feb. 1, 2010, pp. 157-159.
Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.
Krah et al., "Single-domain antibodies for biomedical applications.", Immunopharmacol Immunotoxicol. 2016;38(1):21-8. doi:10.3109/08923973.2015.1102934. Epub Nov. 9, 2015.
Chichili et al., A CD3xCD123 bispecific DART for redirecting host T cells to myelogenous leukemia: preclinical activity and safety in nonhuman primates., Sci Transl Med. May 27, 2015;7(289):289ra82. doi:10.1126/scitranslmed.aaa5693.
Chu et al., Immunotherapy with Long-Lived Anti-CD123 x Anti-CD3 Bispecific Antibodies Stimulates Potent T Cell Mediated Killing of Human AML Cell Lines and of CD123+ Cells in Monkeys: A Potential Therapy for Acute Myelogenous Leukemia, Blood 2014, 124:2316.
Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.

(56) References Cited

OTHER PUBLICATIONS

Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13/0143.
Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.
Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.
Chichili et al., Co-targeting of PD-1 and CTLA-4 Inhibitory Pathways with Bispecific Dart® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.
U.S. Appl. No. 12/875,015, 2011-0054151, U.S. Pat. No. 9,493,578, filed Sep. 2, 2010, Mar. 3, 2011, Nov. 15, 2016.
U.S. Appl. No. 15/279,266, 2017-0058053, filed Sep. 28, 2016, Mar. 2, 2017.
U.S. Appl. No. 13/648,951, 2013-0171095, filed Oct. 10, 2012, Jul. 4, 2013.
U.S. Appl. No. 13/194,904, 2012-0028304, U.S. Pat. No. 8,637,641, filed Jul. 29, 2011, Feb. 2, 2012, Jan. 28, 2014.
U.S. Appl. No. 14/165,487, 2014-0249297, U.S. Pat. No. 9,605,064, filed Jan. 27, 2014, Sep. 4, 2014, Mar. 28, 2017.
U.S. Appl. No. 15/444,087, 2017-0174757, filed Feb. 27, 2017, Jun. 22, 2017.
U.S. Appl. No. 13/568,028, filed Aug. 6, 2012.
U.S. Appl. No. 14/853,622, 2016-0068588, filed Sep. 14, 2015, Mar. 10, 2016.
U.S. Appl. No. 13/887,234, filed May 3, 2013.
U.S. Appl. No. 14/156,431, 2014-0212435, filed Jan. 15, 2014, Jul. 31, 2014.
U.S. Appl. No. 14/156,432, 2014-0212436, filed Jan. 15, 2014, Jul. 31, 2014.
U.S. Appl. No. 14/808,826, 2016-0060360, U.S. Pat. No. 9,738,722, filed Jul. 24, 2015, Mar. 3, 2016, Aug. 22, 2017.
U.S. Appl. No. 15/682,380, filed Aug. 21, 2017.
U.S. Appl. No. 14/155,248, 2014-0322217, filed Jan. 14, 2014, Oct. 30, 2014.
U.S. Appl. No. 14/155,334, 2014-0370013, filed Jan. 14, 2014, Dec. 18, 2014.
U.S. Appl. No. 14/155,344, 2014-0294833, U.S. Pat. No. 9,701,759, filed Jan. 14, 2014, Oct. 2, 2014, Jul. 11, 2017.
U.S. Appl. No. 14/205,227, 2014-0294835, filed Mar. 11, 2014, Oct. 2, 2014.
U.S. Appl. No. 14/205,248, 2014-0288275, U.S. Pat. No. 9,650,446, filed Mar. 11, 2014, Sep. 25, 2014, May 16, 2017.
U.S. Appl. No. 15/589,908, filed May 8, 2017.
U.S. Appl. No. 14/214,418, 2014-0356381, filed Mar. 14, 2014, Dec. 4, 2014.
U.S. Appl. No. 14/214,475, 2014-0294836, filed Mar. 14, 2014, Oct. 2, 2014.
U.S. Appl. No. 14/217,166, 2014-0294759, filed Mar. 17, 2014, Oct. 2, 2014.
U.S. Appl. No. 14/200,652, 2014-0302064, filed Mar. 7, 2014, Oct. 9, 2014.
U.S. Appl. No. 14/207,489, 2014-0377270, filed Mar. 12, 2014, Dec. 25, 2014.
U.S. Appl. No. 14/200,821, 2014-0294823, U.S. Pat. No. 9,605,084, filed Mar. 7, 2014, Oct. 2, 2014, Mar. 28, 2017.
U.S. Appl. No. 14/216,705, 2014-0363426, filed Mar. 17, 2014, Dec. 11, 2014.
U.S. Appl. No. 15/444,026, filed Feb. 27, 2017.
U.S. Appl. No. 14/673,695, 2015-0307629, filed Mar. 30, 2015, Oct. 29, 2015.
U.S. Appl. No. 15/786,252, filed Oct. 17, 2017.
U.S. Appl. No. 14/952,705, 2016-0176969, filed Nov. 25, 2015, Jun. 23, 2016.
U.S. Appl. No. 14/952,714, 2016-0229924, filed Nov. 25, 2015, Aug. 11, 2016.
U.S. Appl. No. 15/141,350, 2016-0355608, filed Apr. 28, 2016, Dec. 8, 2016.
U.S. Appl. No. 14/952,786, 2016-0215063, filed Nov. 25, 2015, Jul. 28, 2016.
U.S. Appl. No. 14/757,809, 2016-0355600, filed Dec. 22, 2015, Dec. 8, 2016.
U.S. Appl. No. 15/063,441, 2017-0037131, filed Mar. 7, 2016, Feb. 9, 2017.
U.S. Appl. No. 15/185,958, 2017-0081420, U.S. Pat. No. 9,850,320, filed Jun. 17, 2016, Mar. 23, 2017, Dec. 26, 2017.
U.S. Appl. No. 15/186,167, 2017-0081424, U.S. Pat. No. 9,856,327, filed Jun. 17, 2016, Mar. 23, 2017, Jan. 2, 2018.
U.S. Appl. No. 15/691,665, filed Aug. 30, 2017.
U.S. Appl. No. 15/785,401, filed Oct. 16, 2017.
U.S. Appl. No. 15/785,393, filed Oct. 16, 2017.
Sun et al. , Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.
Sun et al., Anti-CD20/CD3 T cell-dependent bispecific antibody for the treatment of B cell malignancies., Science Translational Medicine May 13, 2015: vol. 7, Issue 287, pp. 287ra70DOI: 10.1126/scitranslmed.aaa480.
Capizzi et al., Curative chemotherapy for acute myeloid leukemia: the development of high-dose ara-C from the laboratory to bedside., Invest New Drugs. 1996;14(3):249-56.
Giles et al., Intravenous corticosteroids to reduce gemtuzumab ozogamicin infusion reactions. Ann Pharmacother. Sep. 2003;37(9):1182-5.
Duong et al., Targeted treatment of acute myeloid leukemia in older adults: role of gemtuzumab ozogamicin., Clin Intery Aging. 2009;4:197-205. Epub May 14, 2009.
Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.
Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.
Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.
U.S. Appl. No. 15/525,007, 2017-0335007, filed May 5, 2017, Nov. 23, 2017.
U.S. Appl. No. 16/025,963, filed Jul. 2, 2018.

\* cited by examiner

Figure 2

| Pair | | CD25 binding | CD4 binding |
| --- | --- | --- | --- |
| Heavy chain | Light chain | | |
| Basiliximab (CD25) | Ibalizumab (CD4) | - | - |
| Basiliximab (CD25) | OKT4A (CD4) | - | - |
| Basiliximab (CD25) | Zanolimumab (CD4) | - | - |
| HuMax-TAC (CD25) | Ibalizumab (CD4) | - | - |
| HuMax-TAC (CD25) | OKT4A (CD4) | ++ | - |
| HuMax-TAC (CD25) | Zanolimumab (CD4) | + | - |
| Anti-TAC_H1L1 (CD25) | Ibalizumab (CD4) | - | - |
| Anti-TAC_H1L1 (CD25) | OKT4A (CD4) | - | - |
| Anti-TAC_H1L1 (CD25) | Zanolimumab (CD4) | - | - |
| Ibalizumab (CD4) | Basiliximab (CD25) | - | - |
| Ibalizumab (CD4) | HuMax-TAC (CD25) | - | - |
| Ibalizumab (CD4) | Anti-TAC_H1L1 (CD25) | - | - |
| OKT4A (CD4) | Basiliximab (CD25) | - | - |
| OKT4A (CD4) | HuMax-TAC (CD25) | - | - |
| Zanolimumab (CD4) | Basiliximab (CD25) | - | - |
| Zanolimumab (CD4) | HuMax-TAC (CD25) | - | - |
| Zanolimumab (CD4) | Anti-TAC_H1L1 (CD25) | - | - |

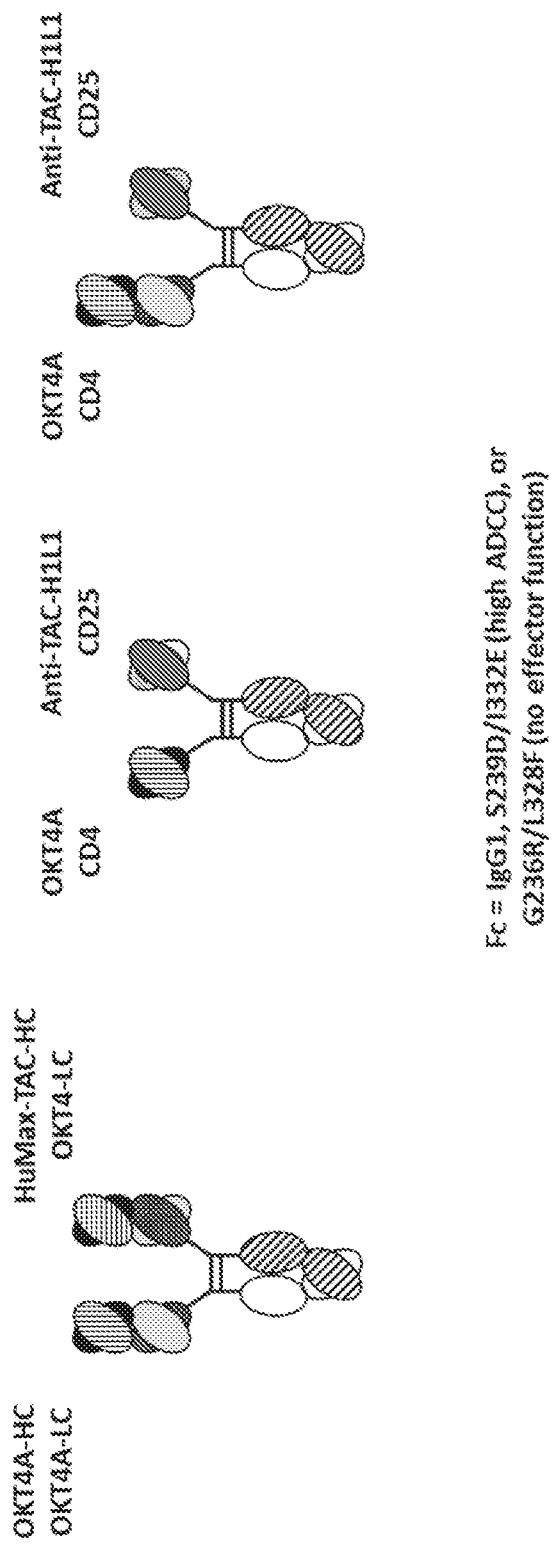

Figure 23

| IL2 affinity variants and references | XENP Number | Variant |
|---|---|---|
| Remove free Cys (Proleukin) | 13637 | hIL2_0.1 |
| Remove free Cys (Proleukin) and o-glycosylation site | 13638 | hIL2_0.2 |
| C. Klein variant - Knocked out binding to IL2Ra (WO2012/107417A1) | 13639 | hIL2_0.3 |
| Variant 2-4 (Increased affinity to IL2Rα) (Wittrup & Rao US7569215B2) | 13640 | hIL2_0.4 |
| Variant M6 - Increased affinity to IL2Rα (1.2nM vs. 30 nM) (Wittrup & Rao US7569215B2) | 13641 | hIL2_0.5 |
| Variant 2-4 with Q126T (dominant negative - no binding to IL2Rγ but high affinity to IL2Rα) | 13642 | hIL2_0.6 |
| Dominant negative (Wittrup & Rao US7569215B2) | 13643 | hIL2_0.7 |
| Dominant negative (enhanced activity for T cells over NK cells) (Shanafelt et al (Nat. Biotech. 18:1197-1202, (2000)).) | 13644 | hIL2_0.8 |

| XENP Number | Variant | Substitutions | IL2Rα | IL2Rβ | IL2Rγ | T cells | NK cells |
|---|---|---|---|---|---|---|---|
| 13637 | hIL2_0.1 | C125S | WT | WT | WT | + | + |
| 13638 | hIL2_0.2 | T3A C125S | WT | WT | WT | + | + |
| 13639 | hIL2_0.3 | T3A F42A Y45A L72G C125A | KO | WT | WT | - | + |
| 13640 | hIL2_0.4 | N29S Y31H K35R T37A K48E V69A N71R Q74P N88D I89V C125S | ++ | WT | WT | +++ | + |
| 13641 | hIL2_0.5 | V69A Q74P I128T C125S | + | WT | WT | ++ | + |
| 13642 | hIL2_0.6 | N29S Y31H K35R T37A K48E V69A N71R Q74P N88D I89V C125S Q126T | ++ | WT | KO | +++ | - |
| 13643 | hIL2_0.7 | C125S Q126T | WT | WT | KO | + | - |
| 13644 | hIL2_0.8 | N88R C125S | WT | KO | WT | + | - |

Figure 30A

OKT4A_H0_IgG1 (SEQ ID NO: 7)

EVILVQSGGALVEPGGSLKLSCSASGFTFS<u>NYAMS</u>WVRQTPEKRLEWVA<u>AISDHSTNTYYPDS
VK</u>GRFTISRDNAKNTLYLQMNSLRSEDTAIYYCAR<u>KYGGDYDPFDY</u>WGQGTTLTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSNTKVDKKVEPKSCDKTHTCPPCPAPELLGGPSVFLFPPKPKDT
LMISRTPEVTCVVVDVSHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYT
QKSLSLSPGK

OKT4A_H0_Hybrid_S239D/I332E (SEQ ID NO: 8)

EVILVQSGGALVEPGGSLKLSCSASGFTFS<u>NYAMS</u>WVRQTPEKRLEWVA<u>AISDHSTNTYYPDS
VK</u>GRFTISRDNAKNTLYLQMNSLRSEDTAIYYCAR<u>KYGGDYDPFDY</u>WGQGTTLTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSNTKVDKKVEPKSCDKTHTCPPCPAPELLGGPDVFLFPPKPKDT
LMISRTPEVTCVVVDVSHEDPEVQFNWYVDGVEVHNAKTKPREEQFNSTFRVVSVLTVVHQD
WLNGKEYKCKVSNKALPAPEEKTISKTKGQPREPQVYTLPPSREEMTKNQVSLTCLVKGFYPS
DIAVEWESNGQPENNYKTTPPMLDSDGSFFLYSKLTVDKSRWQQGNVFSCSVMHEALHNHYT
QKSLSLSPGK

OKT4A_L0 (SEQ ID NO: 9)

DIQMTQSPSSLSASLGGKVTIAC<u>KASQDINNYIA</u>WYQHKPGKGPRLLIH<u>YTSTLQP</u>GIPSRFSGS
GSGRDYSFSISNLEPEDIATYYC<u>LQYDNLLFT</u>FGGGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

HuMax-TAC_H0_IgG1 (SEQ ID NO: 10)

QVQLVQSGAEVKKPGSSVKVSCKASGGTFS<u>RYIIN</u>WVRQAPGQGLEWMG<u>RIIPILGVENYAQK
FQG</u>RVTITADKSTSTAYMELSSLRSEDTAVYYCAR<u>KDWFDY</u>WGQGTLVTVSSASTKGPSVFPL
APSSKSTSGGTAALGCLVKDYFPEPVTVSWNSGALTSGVHTFPAVLQSSGLYSLSSVVTVPSS
SLGTQTYICNVNHKPSNTKVDKKVEPKSCDKTHTCPPCPAPELLGGPSVFLFPPKPKDTLMISR
TPEVTCVVVDVSHEDPEVKFNWYVDGVEVHNAKTKPREEQYNSTYRVVSVLTVLHQDWLNGK
EYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSL
SPGK

Figure 30B

HuMax-TAC_L0 (SEQ ID NO:11)

EIVLTQSPGTLSLSPGERATLSC<u>RASQSVSSYLA</u>WYQQKPGQAPRLLIY<u>GASSRAT</u>GIPDRFSG
SGSGTDFTLTISRLEPEDFAVYYC<u>QQYGSSPLT</u>FGGGTKVEIKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC

Anti-TAC_H1_IgG1 (SEQ ID NO: 12)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSASTKGPSV
FPLAPSSKSTSGGTAALGCLVKDYFPEPVTVSWNSGALTSGVHTFPAVLQSSGLYSLSSVVTV
PSSSLGTQTYICNVNHKPSNTKVDKKVEPKSCDKTHTCPPCPAPELLGGPSVFLFPPKPKDTL
MISRTPEVTCVVVDVSHEDPEVKFNWYVDGVEVHNAKTKPREEQYNSTYRVVSVLTVLHQDW
LNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQ
KSLSLSPGK

Anti-TAC_L1 (SEQ ID NO: 13)

QIVLTQSPATLSLSPGERATLSC<u>RASSSISYMH</u>WFQQKPGQSPQLLIY<u>TTSNLAS</u>GVPARFSGS
GSGTDYTLTISSLQPEDFAVYYC<u>HQRSTYPLT</u>FGSGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Basiliximab_H0 (SEQ ID NO: 14)

QVQLQQSGTVLARPGASVKMSCKASGYSFT<u>RYWMH</u>WIKQRPGQGLEWIG<u>AIYPGNSDTSYN
QKFEG</u>KAKLTAVTSASTAYMELSSLTHEDSAVYYCSR<u>DYGYYFDF</u>WGQGTTLTVSSASTKGPS
VFPLAPSSKSTSGGTAALGCLVKDYFPEPVTVSWNSGALTSGVHTFPAVLQSSGLYSLSSVVT
VPSSSLGTQTYICNVNHKPSNTKVDKKVEPKSCDKTHTCPPCPAPELLGGPSVFLFPPKPKDTL
MISRTPEVTCVVVDVSHEDPEVKFNWYVDGVEVHNAKTKPREEQYNSTYRVVSVLTVLHQDW
LNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQ
KSLSLSPGK

Figure 30C

Basiliximab_L0 (SEQ ID NO: 15)

QIVSTQSPAIMSASPGEKVTMTC<u>SASSSRSYMQ</u>WYQQKPGTSPKRWIY<u>DTSKLAS</u>GVPARFS
GSGSGTSYSLTISSMEAEDAATYYC<u>HQRSSYT</u>FGGGTKLEIKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC

Ibalizumab_H0 (SEQ ID NO: 16)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSAS
TKGPSVFPLAPSSKSTSGGTAALGCLVKDYFPEPVTVSWNSGALTSGVHTFPAVLQSSGLYSL
SSVVTVPSSSLGTQTYICNVNHKPSNTKVDKKVEPKSCDKTHTCPPCPAPELLGGPSVFLFPPK
PKDTLMISRTPEVTCVVVDVSHEDPEVKFNWYVDGVEVHNAKTKPREEQYNSTYRVVSVLTVL
HQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHN
HYTQKSLSLSPGK

Ibalizumab_L0 (SEQ ID NO: 17)

DIVMTQSPDSLAVSLGERVTMNC<u>KSSQSLLYSTNQKNYLA</u>WYQQKPGQSPKLLIY<u>WASTRES</u>
GVPDRFSGSGSGTDFTLTISSVQAEDVAVYYC<u>QQYYSYRT</u>FGGGTKLEIKRTVAAPSVFIFPPS
DEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Zanolimumab_H0 (SEQ ID NO: 18)

QVQLQQWGAGLLKPSETLSLTCAVYGGSFS<u>GYYWS</u>WIRQPPGKGLEWIG<u>EINHSGSTNYNPS
LKS</u>RVTISVDTSKNQFSLKLSSVTAADTAVYYCAR<u>VINWFDP</u>WGQGTLVTVSSASTKGPSVFPL
APSSKSTSGGTAALGCLVKDYFPEPVTVSWNSGALTSGVHTFPAVLQSSGLYSLSSVVTVPSS
SLGTQTYICNVNHKPSNTKVDKKVEPKSCDKTHTCPPCPAPELLGGPSVFLFPPKPKDTLMISR
TPEVTCVVVDVSHEDPEVKFNWYVDGVEVHNAKTKPREEQYNSTYRVVSVLTVLHQDWLNGK
EYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSL
SPGK

Figure 30D

Zanolimumab_L0 (SEQ ID NO: 19)

DIQMTQSPSSVSASVGDRVTITC<u>RASQDISSWLA</u>WYQHKPGKAPKLLIY<u>AASSLQS</u>GVPSRFS
GSGSGTDFTLTISSLQPEDFATYYC<u>QQANSFPYT</u>FGQGTKLEIKRTVAAPSVFIFPPSDEQLKS
GTASVVCLLNNFYPREAKVQWKVDNALQSGNSQESVTEQDSKDSTYSLSSTLTLSKADYEKH
KVYACEVTHQGLSSPVTKSFNRGEC

Figure 30E

OKT4A_H0/HuMAX-TAC_H0_OKT4A_L0_pI_ISO(-/+RR)_IgG1

Heavy chain 1 (OKT4A_H0_pI_ISO(-)_IgG1): (SEQ ID NO: 20)

EVILVQSGGALVEPGGSLKLSCSASGFTFS<u>NYAMS</u>WVRQTPEKRLEWVA<u>AISDHSTNTYYPDS
VK</u>GRFTISRDNAKNTLYLQMNSLRSEDTAIYYCAR<u>KYGGDYDPFDY</u>WGQGTTLTVSSASTKGP
SVFPLAPSSKSTSGGTAALGCLVKDYFPEPVTVSWNSGALTSGVHTFPAVLQSSGLYSLSSVV
TVPSSSLGTQTYTCNVDHKPSNTKVDKKVEPKSCDKTHTCPPCPAPELLGGPSVFLFPPKPKD
TLMISRTPEVTCVVVDVSHEDPEVQFNWYVDGVEVHNAKTKPREEQYNSTYRVVSVLTVLHQ
DWLNGKEYKCKVSNKALPAPIEKTISKAKGQPREPQVYTLPPSQEEMTKNQVSLTCLVKGFYP
SDIAVEWESSGQPENNYNTTPPMLDSDGSFFLYSKLTVDKSRWQEGNVFSCSVMHEALHNHY
TQKSLSLSPG

Heavy chain 2 (HuMAX-TAC_H0_pI_ISO(+RR)_IgG1): (SEQ ID NO: 21)

QVQLVQSGAEVKKPGSSVKVSCKASGGTFS<u>RYIIN</u>WVRQAPGQGLEWMG<u>RIIPILGVENYAQK
FQ</u>GRVTITADKSTSTAYMELSSLRSEDTAVYYCAR<u>KDWFDY</u>WGQGTLVTVSSASTKGPSVFPL
APSSKSTSGGTAALGCLVKDYFPEPVTVSWNSGALTSGVHTFPAVLQSSGLYSLSSVVTVPSS
SLGTKTYTCNVNHKPSNTKVDKKVERKSCDKTHTCPRCPAPELLGGPSVFLFPPKPKDTLMIS
RTPEVTCVVVDVSHEDPEVKFKWYVDGVEVHNAKTKPREEQYNSTYRVVSVLTVLHQDWLNG
KEYKCKVSNKALPAPIEKTISKAKGQPREPQVYTLPPSREEMTKNQVSLTCLVKGFYPSDIAVE
WESNGQPENNYKTTPPVLDSDGSFFLYSKLTVDKSRWQQGNVFSCSVMHEALHNHYTQKSL
SLSPGK

Light chain (OKT4A_L0): (SEQ ID NO: 22)

DIQMTQSPSSLSASLGGKVTIAC<u>KASQDINNYIA</u>WYQHKPGKGPRLLIH<u>YTSTLQPGIPSRFSGS
GSGRDYSFSISNLEPEDIATYYC<u>LQYDNLLFT</u>FGGGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30F

OKT4A_H0/HuMAX-TAC_H0_OKT4A_L0_pI_ISO(-/+RR)_IgG1_S239D/I332E

Heavy chain 1 (OKT4A_H0_pI_ISO(-)_IgG1_S239D/I332E): (SEQ ID NO: 23)

EVILVQSGGALVEPGGSLKLSCSASGFTFS<u>NYAMS</u>WVRQTPEKRLEWVA<u>AISDHSTNTYYPDS
VKG</u>RFTISRDNAKNTLYLQMNSLRSEDTAIYYCAR<u>KYGGDYDPFDY</u>WGQGTTLTVSSASTKGP
SVFPLAPSSKSTSGGTAALGCLVKDYFPEPVTVSWNSGALTSGVHTFPAVLQSSGLYSLSSVV
TVPSSSLGTQTYTCNVDHKPSNTKVDKKVEPKSCDKTHTCPPCPAPELLGGPDVFLFPPKPKD
TLMISRTPEVTCVVVDVSHEDPEVQFNWYVDGVEVHNAKTKPREEQYNSTYRVVSVLTVLHQ
DWLNGKEYKCKVSNKALPAPEEKTISKAKGQPREPQVYTLPPSQEEMTKNQVSLTCLVKGFYP
SDIAVEWESSGQPENNYNTTPPMLDSDGSFFLYSKLTVDKSRWQEGNVFSCSVMHEALHNHY
TQKSLSLSPG

Heavy chain 2 (HuMAX-TAC_H0_pI_ISO(+RR)_IgG1_S239D/I332E): (SEQ ID NO: 24)

QVQLVQSGAEVKKPGSSVKVSCKASGGTFS<u>RYIIN</u>WVRQAPGQGLEWMG<u>RIIPILGVENYAQK
FQG</u>RVTITADKSTSTAYMELSSLRSEDTAVYYCAR<u>KDWFDY</u>WGQGTLVTVSSASTKGPSFPL
APSSKSTSGGTAALGCLVKDYFPEPVTVSWNSGALTSGVHTFPAVLQSSGLYSLSSVVTVPSS
SLGTKTYTCNVNHKPSNTKVDKKVERKSCDKTHTCPRCPAPELLGGPDVFLFPPKPKDTLMIS
RTPEVTCVVVDVSHEDPEVKFKWYVDGVEVHNAKTKPREEQYNSTYRVVSVLTVLHQDWLNG
KEYKCKVSNKALPAPEEKTISKAKGQPREPQVYTLPPSREEMTKNQVSLTCLVKGFYPSDIAVE
WESNGQPENNYKTTPPVLDSDGSFFLYSKLTVDKSRWQQGNVFSCSVMHEALHNHYTQKSL
SLSPGK

Light chain (OKT4A_L0): (SEQ ID NO: 25)

DIQMTQSPSSLSASLGGKVTIAC<u>KASQDINNYIA</u>WYQHKPGKPRLLIH<u>YTSTLQP</u>GIPSRFSGS
GSGRDYSFSISNLEPEDIATYYC<u>LQYDNLLFT</u>FGGGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30G

11216 - OKT4A_H0L0_scFv_Anti-TAC_H1L1_scFv_GDQ-Fc(216)_IgG1_pI_ISO(-)/pI_ISO(+RR)_IgG1_S239D/I332E Heavy chain 1 (OKT4A_H0L0_scFv_GDQ-Fc(216)_IgG1_pI_ISO(-)_S239D/I332E):

(SEQ ID NO: 26)

EVILVQSGGALVEPGGSLKLSCSASGFTFS<u>NYAMS</u>WVRQTPEKRLEWVA<u>AISDHSTNTYYPDS
VK</u>GRFTISRDNAKNTLYLQMNSLRSEDTAIYYCAR<u>KYGGDYDPFDY</u>WGQGTTLTVSSGGGGS
GGGGSGGGGSGGGGSDIQMTQSPSSLSASLGGKVTIAC<u>KASQDINNYIA</u>WYQHKPGKGPRLL
IH<u>YTSTLQPG</u>IPSRFSGSGSGRDYSFSISNLEPEDIATYYC<u>LQYDNLLFT</u>FGGGTKLEIKGDQEP
KSSDKTHTCPPCPAPELLGGPDVFLFPPKPKDTLMISRTPEVTCVVVDVSHEDPEVQFNWYVD
GVEVHNAKTKPREEQYNSTYRVVSVLTVLHQDWLNGKEYKCKVSNKALPAPEEKTISKAKGQP
REPQVYTLPPSQEEMTKNQVSLTCLVKGFYPSDIAVEWESSGQPENNYNTTPPMLDSDGSFFL
YSKLTVDKSRWQEGNVFSCSVMHEALHNHYTQKSLSLSPG

Heavy chain 2 (Anti-TAC_H1L1_scFv_GDQ-Fc(216)_IgG1_pI_ISO(+RR)_S239D/I332E):

(SEQ ID NO: 27)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKGDQERKSS
DKTHTCPRCPAPELLGGPDVFLFPPKPKDTLMISRTPEVTCVVVDVSHEDPEVKFKWYVDGVE
VHNAKTKPREEQYNSTYRVVSVLTVLHQDWLNGKEYKCKVSNKALPAPEEKTISKAKGQPREP
QVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK

Light chain (OKT4A_L0): (SEQ ID NO: 28)

DIQMTQSPSSLSASLGGKVTIAC<u>KASQDINNYIA</u>WYQHKPGKGPRLLIH<u>YTSTLQPG</u>IPSRFSGS
GSGRDYSFSISNLEPEDIATYYC<u>LQYDNLLFT</u>FGGGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30H

12143 - OKT4A_H0L0_scFv_Anti-TAC_H1L1_scFv_-Fc(216)_IgG1_pI_ISO(-)/pI_ISO(+RR)_C220S/FcKO Heavy chain 1 (OKT4A_H0L0_scFv_Fc(216)_IgG1_pI_ISO(-)_G236R/L328R):

(SEQ ID NO: 29)

EVILVQSGGALVEPGGSLKLSCSASGFTFS<u>NYAMS</u>WVRQTPEKRLEWVA<u>AISDHSTNTYYPDS</u>
<u>VKG</u>RFTISRDNAKNTLYLQMNSLRSEDTAIYYCAR<u>KYGGDYDPFDY</u>WGQGTTLTVSSGGGGS
GGGGSGGGGSGGGGSDIQMTQSPSSLSASLGGKVTIAC<u>KASQDINNYIA</u>WYQHKPGKGPRLL
IH<u>YTSTLQP</u>GIPSRFSGSGSGRDYSFSISNLEPEDIATYYC<u>LQYDNLLFT</u>FGGGTKLEIKEPKSSD
KTHTCPPCPAPELLRGPSVFLFPPKPKDTLMISRTPEVTCVVVDVSHEDPEVQFNWYVDGVEV
HNAKTKPREEQYNSTYRVVSVLTVLHQDWLNGKEYKCKVSNKARPAPIEKTISKAKGQPREPQ
VYTLPPSQEEMTKNQVSLTCLVKGFYPSDIAVEWESSGQPENNYNTTPPMLDSDGSFFLYSKL
TVDKSRWQEGNVFSCSVMHEALHNHYTQKSLSLSPG

Heavy chain 2 (Anti-TAC_H1L1_scFv_Fc(216)_IgG1_pI_ISO(+RR)_G236R/L328R):

(SEQ ID NO: 30)

QVQLVQSGAEVKKPGASVKVSCKASGYTFT<u>SYRMH</u>WVRQAPGQGLEWMG<u>YINPSTGYTEYN</u>
<u>QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT</u>
<u>SNLAS</u>GVPARFSGSGSGTDYTLTISSLQPEDFAVYYC<u>HQRSTYPLT</u>FGSGTKLEIKERKSSDKT
HTCPRCPAPELLRGPSVFLFPPKPKDTLMISRTPEVTCVVVDVSHEDPEVKFKWYVDGVEVHN
AKTKPREEQYNSTYRVVSVLTVLHQDWLNGKEYKCKVSNKARPAPIEKTISKAKGQPREPQVY
TLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK

Figure 30I

11209 - OKT4A_H0L0_scFv_Anti-TAC_H1L1_scFv_GDQ-Fc(216)_IgG1_pI_ISO(-)/pI_ISO(+RR)_IgG1

Heavy chain 1 (OKT4A_H0L0_scFv_GDQ-Fc(216)_IgG1_pI_ISO(-)):(SEQ ID NO: 31)

EVILVQSGGALVEPGGSLKLSCSASGFTFS<u>NYAMS</u>WVRQTPEKRLEWVA<u>AISDHSTNTYYPDS
VK</u>GRFTISRDNAKNTLYLQMNSLRSEDTAIYYCAR<u>KYGGDYDPFDY</u>WGQGTTLTVSSGGGGS
GGGGSGGGGSGGGGSDIQMTQSPSSLSASLGGKVTIAC<u>KASQDINNYIA</u>WYQHKPGKGPRLL
IH<u>YTSTLQP</u>GIPSRFSGSGSGRDYSFSISNLEPEDIATYYC<u>LQYDNLLFT</u>FGGGTKLEIKGDQEP
KSSDKTHTCPPCPAPELLGGPSVFLFPPKPKDTLMISRTPEVTCVVVDVSHEDPEVQFNWYVD
GVEVHNAKTKPREEQYNSTYRVVSVLTVLHQDWLNGKEYKCKVSNKALPAPIEKTISKAKGQP
REPQVYTLPPSQEEMTKNQVSLTCLVKGFYPSDIAVEWESSGQPENNYNTTPPMLDSDGSFFL
YSKLTVDKSRWQEGNVFSCSVMHEALHNHYTQKSLSLSPG

Heavy chain 2 (Anti-TAC_H1L1_scFv_GDQ-Fc(216)_IgG1_pI_ISO(+RR)): (SEQ ID NO: 32)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSQIVLTQSPATLSLSPGERATLSC<u>RASSSISYMH</u>WFQQKPGQSPQLLIY<u>TT
SNLAS</u>GVPARFSGSGSGTDYLTISSLQPEDFAVYYC<u>HQRSTYPLT</u>FGSGTKLEIKGDQERKSS
DKTHTCPRCPAPELLGGPSVFLFPPKPKDTLMISRTPEVTCVVVDVSHEDPEVKFKWYVDGVE
VHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK

Figure 30J

11919 - OKT4A_H0/HuMAX-TAC_H0_OKT4A_L0_pI_ISO(-/+RR)_G236R/L328R

Heavy chain 1 (OKT4A_H0_IgG1_pI_ISO(-)_G236R/L328R): (SEQ ID NO: 33)

EVILVQSGGALVEPGGSLKLSCSASGFTFS<u>NYAMS</u>WVRQTPEKRLEWVA<u>AISDHSTNTYYPDS
VKG</u>RFTISRDNAKNTLYLQMNSLRSEDTAIYYCAR<u>KYGGDYDPFDY</u>WGQGTTLTVSSASTKGP
SVFPLAPSSKSTSGGTAALGCLVKDYFPEPVTVSWNSGALTSGVHTFPAVLQSSGLYSLSSVV
TVPSSSLGTQTYTCNVDHKPSNTKVDKKVEPKSCDKTHTCPPCPAPELLRGPSVFLFPPKPKD
TLMISRTPEVTCVVVDVSHEDPEVQFNWYVDGVEVHNAKTKPREEQYNSTYRVVSVLTVLHQ
DWLNGKEYKCKVSNKARPAPIEKTISKAKGQPREPQVYTLPPSQEEMTKNQVSLTCLVKGFYP
SDIAVEWESSGQPENNYNTTPPMLDSDGSFFLYSKLTVDKSRWQEGNVFSCSVMHEALHNHY
TQKSLSLSPG

Heavy chain 2 (HuMAX-TAC_H0_IgG1_pI_ISO(+RR)_G236R/L328R): (SEQ ID NO: 34)

QVQLVQSGAEVKKPGSSVKVSCKASGGTFS<u>RYIIN</u>WVRQAPGQGLEWMG<u>RIIPILGVENYAQK
FQG</u>RVTITADKSTSTAYMELSSLRSEDTAVYYCAR<u>KDWFDY</u>WGQGTLVTVSSASTKGPSVFPL
APSSKSTSGGTAALGCLVKDYFPEPVTVSWNSGALTSGVHTFPAVLQSSGLYSLSSVVTVPSS
SLGTKTYTCNVNHKPSNTKVDKKVERKSCDKTHTCPRCPAPELLRGPSVFLFPPKPKDTLMISR
TPEVTCVVVDVSHEDPEVKFKWYVDGVEVHNAKTKPREEQYNSTYRVVSVLTVLHQDWLNGK
EYKCKVSNKARPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSL
SPGK

Light chain (OKT4A_L0): (SEQ ID NO: 35)

DIQMTQSPSSLSASLGGKVTIAC<u>KASQDINNYIA</u>WYQHKPGKPRLLIH<u>YTSTLQPG</u>IPSRFSGS
GSGRDYSFSISNLEPEDIATYYC<u>LQYDNLLFT</u>FGGGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30K

13027 - hIL2_OKT4A_H1L1_IgG1_pI_ISO(-/+RR)_C220S_G236R/L328R

Heavy chain 1 (hIL2_IgG1_pI_ISO(-)_C220S/G236R/L328R): (SEQ ID NO: 36)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPG

Heavy chain 2 (OKT4A_H1_IgG1_pI_ISO(+RR)_G236R/L328R): (SEQ ID NO: 37)

EVQLVESGGGLVQPGGSLRLSCAASGFTFS<u>NYAMS</u>WVRQAPGKRLEWVS<u>AISDHSTNTYYPD
SVKG</u>RFTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 38)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30L

13042 - hIL2_IgG1_pI_ISO(-/-)_C220S/G236R/L328R

Heavy chain (hIL2_IgG1_pI_ISO(-)_C220S/G236R/L328R): (SEQ ID NO: 39)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPG

Figure 30M

13044 - hIL2_empty-Fc(216)_IgG1_pI_ISO(-/+)_C220S/G236R/L328R

Heavy chain 1 (hIL2_IgG1_pI_ISO(-)_C220S/G236R/L328R): (SEQ ID NO: 40)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPG

Heavy chain 2 (empty-Fc(216)_IgG1_pI_ISO(+)_G236R/L328R): (SEQ ID NO: 41)

EPKSSDKTHTCPPCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Figure 30N

13038 - OKT4A_H1L1_IgG1_G236R/L328R_hIL2(2)

Heavy chain (OKT4A_H1_IgG1_G236R/L328R_hIL2): (SEQ ID NO: 42)

EVQLVESGGGLVQPGGSLRLSCAASGFTFS<u>NYAMS</u>WVRQAPGKRLEWVS<u>AISDHSTNTYYPD
SVKG</u>RFTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLRGPSVFLFPPKPK
DTLMISRTPEVTCVVVDVSHEDPEVKFNWYVDGVEVHNAKTKPREEQYNSTYRVVSVLTVLHQ
DWLNGKEYKCKVSNKARPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHY
TQKSLSLSPGKGGGGSGGGGSAPTSSSTKKTQLQLEHLLLDLQMILNGINNYKNPKLTRMLTF
KFYMPKKATELKHLQCLEEELKPLEEVLNLAQSKNFHLRPRDLISNINVIVLELKGSETTFMCEY
ADETATIVEFLNRWITFCQSIISTLT

Light chain (OKT4A_L1): (SEQ ID NO: 43)

DIQMTQSPSSLSASVGDRVTITC<u>QASQDINNYIA</u>WYQHKPGKGPKLLIH<u>YTSTLQPG</u>IPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30O 6368 (Anti-TAC_H1L1 IgG1)

Heavy chain (anti-TAC_H1_IgG1): (SEQ ID NO: 44)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSASTKGPSV
FPLAPSSKSTSGGTAALGCLVKDYFPEPVTVSWNSGALTSGVHTFPAVLQSSGLYSLSSVVTV
PSSSLGTQTYICNVNHKPSNTKVDKKVEPKSCDKTHTCPPCPAPELLGGPSVFLFPPKPKDTL
MISRTPEVTCVVVDVSHEDPEVKFNWYVDGVEVHNAKTKPREEQYNSTYRVVSVLTVLHQDW
LNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQ
KSLSLSPGK

Light chain (Anti-TAC_L1): (SEQ ID NO: 45)

QIVLTQSPATLSLSPGERATLSC<u>RASSSISYMH</u>WFQQKPGQSPQLLIY<u>TTSNLAS</u>GVPARFSGS
GSGTDYTLTISSLQPEDFAVYYC<u>HQRSTYPLT</u>FGSGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30P

6369 – Daclizumab IgG1

Heavy chain (daclizumab_H0_IgG1): (SEQ ID NO: 46)

QVQLVQSGAEVKKPGSSVKVSCKASGYTFT<u>SYRMH</u>WVRQAPGQGLEWIG<u>YINPSTGYTEYN
QKFKD</u>KATITADESTNTAYMELSSLRSEDTAVYYCAR<u>GGGVFDY</u>WGQGTLVTVSSASTKGPSV
FPLAPSSKSTSGGTAALGCLVKDYFPEPVTVSWNSGALTSGVHTFPAVLQSSGLYSLSSVVTV
PSSSLGTQTYICNVNHKPSNTKVDKKVEPKSCDKTHTCPPCPAPELLGGPSVFLFPPKPKDTL
MISRTPEVTCVVVDVSHEDPEVKFNWYVDGVEVHNAKTKPREEQYNSTYRVVSVLTVLHQDW
LNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQ
KSLSLSPGK

Light chain (daclizumab_L0): (SEQ ID NO: 47)

DIQMTQSPSTLSASVGDRVTITC<u>SASSSISYMH</u>WYQQKPGKAPKLLIY<u>TTSNLAS</u>GVPARFSGS
GSGTEFTLTISSLQPDDFATYYC<u>HQRSTYPLT</u>FGQGTKVEVKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC

Figure 30Q 10966 (OKT4A IgG1)

Heavy chain (OKT4A_H0_IgG1): (SEQ ID NO: 48)

EVILVQSGGALVEPGGSLKLSCSASGFTFS<u>NYAMS</u>WVRQTPEKRLEWVA<u>AISDHSTNTYYPDS
VKG</u>RFTISRDNAKNTLYLQMNSLRSEDTAIYYCAR<u>KYGGDYDPFDY</u>WGQGTTLTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSNTKVDKKVEPKSCDKTHTCPPCPAPELLGGPSVFLFPPKPKDT
LMISRTPEVTCVVVDVSHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYT
QKSLSLSPGK

Light chain (OKT4A_L0): (SEQ ID NO: 49)

DIQMTQSPSSLSASLGGKVTIAC<u>KASQDINNYIA</u>WYQHKPGKGPRLLIH<u>YTSTLQ</u>PGIPSRFSGS
GSGRDYSFSISNLEPEDIATYYC<u>LQYDNLLFT</u>FGGGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30R 4546 (Numax IgG1)

Heavy chain (Numax_H0 IgG1): (SEQ ID NO: 50)

QVTLRESGPALVKPTQTLTLTCTFSGFSLS<u>TAGMSVG</u>WIRQPPGKALEWLA<u>DIWWDDKKHYN
PSLKDRL</u>TISKDTSKNQVVLKVTNMDPADTATYYCAR<u>DMIFNFYFDV</u>WGQGTTVTVSSASTKG
PSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPELLGGPSVFLFPPKPKD
TLMISRTPEVTCVVVDVSHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYT
QKSLSLSPGK

Light chain (Numax_L0): (SEQ ID NO: 51)

DIQMTQSPSTLSASVGDRVTITC<u>SASSRVGYMH</u>WYQQKPGKAPKLLIY<u>DTSKLAS</u>GVPSRFSG
SGSGTEFTLTISSLQPDDFATYYC<u>FQGSGYPFT</u>FGGGTKVEIKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC

Figure 30S

12462 - OKT4A_H1L1_Fab-Anti-TAC_H1L1_scFv_Fc(216)_IgG1_pI_ISO(-)-pI_ISO(+RR)_C220S_IgG1_G236R/L328R Heavy chain 1 (OKT4A_H1_IgG1_pI_ISO(-)_G236R/L328R): (SEQ ID NO: 52)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYTCNVDHKPSNTKVDKKVEPKSCDKTHTCPPCPAPELLRGPSVFLFPPKP
KDTLMISRTPEVTCVVVDVSHEDPEVQFNWYVDGVEVHNAKTKPREEQYNSTYRVVSVLTVLH
QDWLNGKEYKCKVSNKARPAPIEKTISKAKGQPREPQVYTLPPSQEEMTKNQVSLTCLVKGFY
PSDIAVEWESSGQPENNYNTTPPMLDSDGSFFLYSKLTVDKSRWQEGNVFSCSVMHEALHNH
YTQKSLSLSPG

Heavy chain 2 (Anti-TAC_H1L1_scFv_Fc(216)_IgG1_pI_ISO(+RR)_G236R/L328R):
(SEQ ID NO: 53)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSQIVLTQSPATLSLPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKERKSSDKT
HTCPRCPAPELLRGPSVFLFPPKPKDTLMISRTPEVTCVVVDVSHEDPEVKFKWYVDGVEVHN
AKTKPREEQYNSTYRVVSVLTVLHQDWLNGKEYKCKVSNKARPAPIEKTISKAKGQPREPQVY
TLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK

Light chain (OKT4A_L1): (SEQ ID NO: 54)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30T

13488 – (OKT4A_H1L1 IgG1)

Heavy chain (OKT4A_H1_IgG1): (SEQ ID NO: 55)

EVQLVESGGGLVQPGGSLRLSCAASGFTFSNYAMSWVRQAPGKRLEWVSAISDHSTNTYYPD
SVKGRFTISRDNAKNTLYLQMNSLRAEDTAVYYCARKYGGDYDPFDYWGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPK
DTLMISRTPEVTCVVVDVSHEDPEVKFNWYVDGVEVHNAKTKPREEQYNSTYRVVSVLTVLHQ
DWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHY
TQKSLSLSPGK

Light chain (OKT4A_L1): (SEQ ID NO: 56)

DIQMTQSPSSLSASVGDRVTITCQASQDINNYIAWYQHKPGKGPKLLIHYTSTLQPGIPSRFSGS
GSGRDYTLTISSLQPEDFATYYCLQYDNLLFTFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30U

13489 - OKT4A_H1L1_IgG1_G236R/L328R

Heavy chain (OKT4A_H1_IgG1_G236R/L328R): (SEQ ID NO: 57)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLRGPSVFLFPPKPK
DTLMISRTPEVTCVVVDVSHEDPEVKFNWYVDGVEVHNAKTKPREEQYNSTYRVVSVLTVLHQ
DWLNGKEYKCKVSNKARPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHY
TQKSLSLSPGK

Light chain (OKT4A_L1): (SEQ ID NO: 58)

DIQMTQSPSSLSASVGDRVTITC<u>QASQDINNYIA</u>WYQHKPGKGPKLLIH<u>YTSTLQPG</u>IPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30V

13501 - OKT4A_H1L1_Fab_empty-Fc(216)_IgG1_pI_ISO(-)_pI_ISO(+RR)_C220S_IgG1

Heavy chain 1 (OKT4A_H1_IgG1_pI_ISO(-))(SEQ ID NO: 59)

EVQLVESGGGLVQPGGSLRLSCAASGFTFSNYAMSWVRQAPGKRLEWVSAISDHSTNTYYPD
SVKGRFTISRDNAKNTLYLQMNSLRAEDTAVYYCARKYGGDYDPFDYWGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYTCNVDHKPSNTKVDKKVEPKSCDKTHTCPPCPAPELLGGPSVFLFPPKP
KDTLMISRTPEVTCVVVDVSHEDPEVQFNWYVDGVEVHNAKTKPREEQYNSTYRVVSVLTVLH
QDWLNGKEYKCKVSNKALPAPIEKTISKAKGQPREPQVYTLPPSQEEMTKNQVSLTCLVKGFY
PSDIAVEWESSGQPENNYNTTPPMLDSDGSFFLYSKLTVDKSRWQEGNVFSCSVMHEALHNH
YTQKSLSLSPG

Heavy chain 2 (empty-Fc(216)_IgG1_pI_ISO(+RR)_C220S): (SEQ ID NO: 60)

ERKSSDKTHTCPRCPAPELLGGPSVFLFPPKPKDTLMISRTPEVTCVVVDVSHEDPEVKFKWY
VDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Light chain (OKT4A_L1): (SEQ ID NO: 61)

DIQMTQSPSSLSASVGDRVTITCQASQDINNYIAWYQHKPGKGPKLLIHYTSTLQPGIPSRFSGS
GSGRDYTLTISSLQPEDFATYYCLQYDNLLFTFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30W

13495 - empty-Fc_Anti-TAC_H1L1_scFv_Fc(216)_IgG1_pI_ISO(-)-pI_ISO(+RR)_C220S_IgG1

Heavy chain 1 (empty-Fc(216)_IgG1_pI_ISO(-)_C220S) (SEQ ID NO: 62)

EPKSSDKTHTCPPCPAPELLGGPSVFLFPPKPKDTLMISRTPEVTCVVVDVSHEDPEVQFNWY
VDGVEVHNAKTKPREEQYNSTYRVVSVLTVLHQDWLNGKEYKCKVSNKALPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPG

Heavy chain 2 (Anti-TAC_H1L1_scFv_Fc(216)_IgG1_pI_ISO(+RR)) (SEQ ID NO: 63)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKERKSSDKT
HTCPRCPAPELLGGPSVFLFPPKPKDTLMISRTPEVTCVVVDVSHEDPEVKFKWYVDGVEVHN
AKTKPREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK

Figure 30X

13025 - OKT4A_H1L1_scFv-Anti-TAC_H1L1_scFv_Fc(216)_IgG1_pI_ISO(-)-pI_ISO(+RR)_C220S_G236R_L328R Heavy chain 1 (OKT4A_H1L1_scFv_Fc(216)_IgG1_pI_ISO(-)_G236R_L328R):

(SEQ ID NO: 64)

EVQLVESGGGLVQPGGSLRLSCAASGFTFSNYAMSWVRQAPGKRLEWVSAISDHSTNTYYPD
SVKGRFTISRDNAKNTLYLQMNSLRAEDTAVYYCARKYGGDYDPFDYWGQGTLVTVSSGGGG
SGGGGSGGGGSGGGGSDIQMTQSPSSLSASVGDRVTITCQASQDINNYIAWYQHKPGKGPKL
LIHYTSTLQPGIPSRFSGSGSGRDYTLTISSLQPEDFATYYCLQYDNLLFTFGGGTKVEIKEPKS
SDKTHTCPPCPAPELLRGPSVFLFPPKPKDTLMISRTPEVTCVVVDVSHEDPEVQFNWYVDGV
EVHNAKTKPREEQYNSTYRVVSVLTVLHQDWLNGKEYKCKVSNKARPAPIEKTISKAKGQPRE
PQVYTLPPSQEEMTKNQVSLTCLVKGFYPSDIAVEWESSGQPENNYNTTPPMLDSDGSFFLYS
KLTVDKSRWQEGNVFSCSVMHEALHNHYTQKSLSLSPG

Heavy chain 2 (Anti-TAC_H1L1_scFv_Fc(216)_IgG1_pI_ISO(+RR)_G236R/L328R):

(SEQ ID NO: 65)

QVQLVQSGAEVKKPGASVKVSCKASGYTFTSYRMHWVRQAPGQGLEWMGYINPSTGYTEYN
QKFQGRVTITADKSISTAYMELSRLRSDDTAVYYCARGGGVFDYWGQGTLVTVSSGGGGSGG
GGSGGGGSGGGGSQIVLTQSPATLSLSPGERATLSCRASSSISYMHWFQQKPGQSPQLLIYTT
SNLASGVPARFSGSGSGTDYTLTISSLQPEDFAVYYCHQRSTYPLTFGSGTKLEIKERKSSDKT
HTCPRCPAPELLRGPSVFLFPPKPKDTLMISRTPEVTCVVVDVSHEDPEVKFKWYVDGVEVHN
AKTKPREEQYNSTYRVVSVLTVLHQDWLNGKEYKCKVSNKARPAPIEKTISKAKGQPREPQVY
TLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK

Figure 30Y

13496 - empty-Fc_Anti-TAC_H1L1_scFv_Fc(216)_IgG1_pI_ISO(-)-pI_ISO(+RR)_C220S_IgG1_G236R/L328R Heavy chain 1 (empty-Fc(216)_IgG1_pI_ISO(-)_G236R/L328R): (SEQ ID NO: 66)

EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPG

Heavy chain 2 (Anti-TAC_H1L1_scFv_Fc(216)_IgG1_pI_ISO(+RR)_G236R/L328R):

(SEQ ID NO: 67)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKERKSSDKT
HTCPRCPAPELLRGPSVFLFPPKPKDTLMISRTPEVTCVVVDVSHEDPEVKFKWYVDGVEVHN
AKTKPREEQYNSTYRVVSVLTVLHQDWLNGKEYKCKVSNKARPAPIEKTISKAKGQPREPQVY
TLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK

Figure 30Z

13529 - Ibalizumab_H0L0_Fab-Anti-TAC_H1L1_scFv_Fc(216)_IgG1_pI_ISO(-)-
pI_ISO(+RR)_C220S_IgG1_G236R/L328R Heavy chain 1 (Ibalizumab_H0_IgG1_pI_ISO(-)_G236R/L328R): (SEQ ID NO: 68)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSAS
TKGPSVFPLAPSSKSTSGGTAALGCLVKDYFPEPVTVSWNSGALTSGVHTFPAVLQSSGLYSL
SSVVTVPSSSLGTQTYTCNVDHKPSNTKVDKKVEPKSCDKTHTCPPCPAPELLRGPSVFLFPP
KPKDTLMISRTPEVTCVVVDVSHEDPEVQFNWYVDGVEVHNAKTKPREEQYNSTYRVVSVLTV
LHQDWLNGKEYKCKVSNKARPAPIEKTISKAKGQPREPQVYTLPPSQEEMTKNQVSLTCLVKG
FYPSDIAVEWESSGQPENNYNTTPPMLDSDGSFFLYSKLTVDKSRWQEGNVFSCSVMHEALH
NHYTQKSLSLSPG

Heavy chain 2 (Anti-TAC_H1L1_scFv_Fc(216)_IgG1_pI_ISO(+RR)_G236R/L328R):

(SEQ ID NO: 69)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKERKSSDKT
HTCPRCPAPELLRGPSVFLFPPKPKDTLMISRTPEVTCVVVDVSHEDPEVKFKWYVDGVEVHN
AKTKPREEQYNSTYRVVSVLTVLHQDWLNGKEYKCKVSNKARPAPIEKTISKAKGQPREPQVY
TLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK

Light chain (Ibalizumab_L0) (SEQ ID NO: 70)

DIVMTQSPDSLAVSLGERVTMNC<u>KSSQSLLYSTNQKNYLA</u>WYQQKPGQSPKLLIY<u>WASTRES</u>
GVPDRFSGSGSGTDFTLTISSVQAEDVAVYYC<u>QQYYSYRT</u>FGGGTKLEIKRTVAAPSVFIFPPS
DEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Figure 30AA

13538 - Ibalizumab_H0L0_Fab_empty-Fc(216)_IgG1_pI_ISO(-)_pI_ISO(+RR)_IgG1_C220S/G236R/L328R Heavy chain 1 (Ibalizumab_H0_IgG1_pI_ISO(-)_G236R/L328R): (SEQ ID NO: 71)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSAS
TKGPSVFPLAPSSKSTSGGTAALGCLVKDYFPEPVTVSWNSGALTSGVHTFPAVLQSSGLYSL
SSVVTVPSSSLGTQTYTCNVDHKPSNTKVDKKVEPKSCDKTHTCPPCPAPELLRGPSVFLFPP
KPKDTLMISRTPEVTCVVVDVSHEDPEVQFNWYVDGVEVHNAKTKPREEQYNSTYRVVSVLTV
LHQDWLNGKEYKCKVSNKARPAPIEKTISKAKGQPREPQVYTLPPSQEEMTKNQVSLTCLVKG
FYPSDIAVEWESSGQPENNYNTTPPMLDSDGSFFLYSKLTVDKSRWQEGNVFSCSVMHEALH
NHYTQKSLSLSPG

Heavy chain 2 (empty-Fc(216)_IgG1_pI_ISO(+RR)_C220S/G236R/L328R): (SEQ ID NO: 72)

ERKSSDKTHTCPRCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Light chain (Ibalizumab_L0): (SEQ ID NO: 73)

DIVMTQSPDSLAVSLGERVTMNC<u>KSSQSLLYSTNQKNYLA</u>WYQQKPGQSPKLLIY<u>WASTRES</u>
GVPDRFSGSGSGTDFTLTISSVQAEDVAVYYC<u>QQYYSYRT</u>FGGGTKLEIKRTVAAPSVFIFPPS
DEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Figure 30BB

13531 - OKT4A_H1L1_Fab-Anti-TAC_H1.8L1_scFv_Fc(216)_IgG1_pI_ISO(-)-
pI_ISO(+RR)_C220S_IgG1_G236R/L328R Heavy chain 1 (OKT4A_H1_IgG1_pI_ISO(-)_G236R/L328R): (SEQ ID NO: 74)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYTCNVDHKPSNTKVDKKVEPKSCDKTHTCPPCPAPELLRGPSVFLFPPKP
KDTLMISRTPEVTCVVVDVSHEDPEVQFNWYVDGVEVHNAKTKPREEQYNSTYRVVSVLTVLH
QDWLNGKEYKCKVSNKARPAPIEKTISKAKGQPREPQVYTLPPSQEEMTKNQVSLTCLVKGFY
PSDIAVEWESSGQPENNYNTTPPMLDSDGSFFLYSKLTVDKSRWQEGNVFSCSVMHEALHNH
YTQKSLSLSPG

Heavy chain 2 (Anti-TAC_H1.8L1_scFv_Fc(216)_IgG1_pI_ISO(+RR)_G236R/L328R):
(SEQ ID NO: 75)

QVQLVQSGAEVKKPGASVKVSCKASGYTFT<u>SYRMH</u>WVRQAPGQGLEWMG<u>WINPSTGYTEY
NQKFQG</u>RVTITADKSISTAYMELSRLRSDDTAVYYCAR<u>GGVFDY</u>WGQGTLVTVSSGGGGSG
GGGSGGGGSGGGGSQIVLTQSPATLSLSPGERATLSC<u>RASSSISYMH</u>WFQQKPGQSPQLLIY
<u>TTSNLAS</u>GVPARFSGSGSGTDYTLTISSLQPEDFAVYYC<u>HQRSTYPLT</u>FGSGTKLEIKERKSSD
KTHTCPRCPAPELLRGPSVFLFPPKPKDTLMISRTPEVTCVVVDVSHEDPEVKFKWYVDGVEV
HNAKTKPREEQYNSTYRVVSVLTVLHQDWLNGKEYKCKVSNKARPAPIEKTISKAKGQPREPQ
VYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light chain (OKT4A_L1): (SEQ ID NO: 76)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30CC

13533 - OKT4A_H1L1_Fab-Anti-TAC_H1L1.12L1_scFv_Fc(216)_IgG1_pI_ISO(-)-pI_ISO(+RR)_C220S_IgG1_G236R/L328R Heavy chain 1 (OKT4A_H1_IgG1_pI_ISO(-)_G236R/L328R): (SEQ ID NO: 77)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYTCNVDHKPSNTKVDKKVEPKSCDKTHTCPPCPAPELLRGPSVFLFPPKP
KDTLMISRTPEVTCVVVDVSHEDPEVQFNWYVDGVEVHNAKTKPREEQYNSTYRVVSVLTVLH
QDWLNGKEYKCKVSNKARPAPIEKTISKAKGQPREPQVYTLPPSQEEMTKNQVSLTCLVKGFY
PSDIAVEWESSGQPENNYNTTPPMLDSDGSFFLYSKLTVDKSRWQEGNVFSCSVMHEALHNH
YTQKSLSLSPG

Heavy chain 2 (Anti-TAC_H1L1.12_scFv_Fc(216)_IgG1_pI_ISO(+RR)_G236R/L328R):

(SEQ ID NO: 78)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>T
ASNLAS</u>GVPARFSGSGSGTDYTLTISSLQPEDFAVYYC<u>HQRSTYPLT</u>FGSGTKLEIKERKSSDK
THTCPRCPAPELLRGPSVFLFPPKPKDTLMISRTPEVTCVVVDVSHEDPEVKFKWYVDGVEVH
NAKTKPREEQYNSTYRVVSVLTVLHQDWLNGKEYKCKVSNKARPAPIEKTISKAKGQPREPQV
YTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK

Light chain (OKT4A_L1): (SEQ ID NO: 79)

DIQMTQSPSSLSASVGDRVTITC<u>QASQDINNYIA</u>WYQHKPGKGPKLLIH<u>YTSTLQPGIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30DD

13530 - OKT4A_H1L1_Fab_empty-Fc(216)_IgG1_pI_ISO(-)_pI_ISO(+RR)_IgG1_C220S/G236R/L328R Heavy chain 1 (OKT4A_H1_IgG1_pI_ISO(-)_G236R/L328R): (SEQ ID NO: 80)

EVQLVESGGGLVQPGGSLRLSCAASGFTFSNYAMSWVRQAPGKRLEWVSAISDHSTNTYYPD
SVKGRFTISRDNAKNTLYLQMNSLRAEDTAVYYCARKYGGDYDPFDYWGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYTCNVDHKPSNTKVDKKVEPKSCDKTHTCPPCPAPELLRGPSVFLFPPKP
KDTLMISRTPEVTCVVVDVSHEDPEVQFNWYVDGVEVHNAKTKPREEQYNSTYRVVSVLTVLH
QDWLNGKEYKCKVSNKARPAPIEKTISKAKGQPREPQVYTLPPSQEEMTKNQVSLTCLVKGFY
PSDIAVEWESSGQPENNYNTTPPMLDSDGSFFLYSKLTVDKSRWQEGNVFSCSVMHEALHNH
YTQKSLSLSPG

Heavy chain 2 (empty-Fc(216)_IgG1_pI_ISO(+RR)_C220S/G236R/L328R): (SEQ ID NO: 81)

ERKSSDKTHTCPRCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Light chain (OKT4A_L1): (SEQ ID NO: 82)

DIQMTQSPSSLSASVGDRVTITCQASQDINNYIAWYQHKPGKGPKLLIHYTSTLQPGIPSRFSGS
GSGRDYTLTISSLQPEDFATYYCLQYDNLLFTFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 30EE

13534 - empty-Fc_Anti-TAC_H1L1.12L1_scFv_Fc(216)_IgG1_pI_ISO(-)-pI_ISO(+RR)_C220S_IgG1_G236R/L328R Heavy chain 1 (empty-Fc(216)_IgG1_pI_ISO(-)_G236R/L328R): (SEQ ID NO: 83)

EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPG

Heavy chain 2 (Anti-TAC_H1L1.12_scFv_Fc(216)_IgG1_pI_ISO(+RR)_G236R/L328R):

(SEQ ID NO: 84)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>T
ASNLAS</u>GVPARFSGSGSGTDYTLTISSLQPEDFAVYYC<u>HQRSTYPLT</u>FGSGTKLEIKERKSSDK
THTCPRCPAPELLRGPSVFLFPPKPKDTLMISRTPEVTCVVVDVSHEDPEVKFKWYVDGVEVH
NAKTKPREEQYNSTYRVVSVLTVLHQDWLNGKEYKCKVSNKARPAPIEKTISKAKGQPREPQV
YTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK

Figure 30FF

13532 - empty-Fc_Anti-TAC_H1.8L1_scFv_Fc(216)_IgG1_pI_ISO(-)-pI_ISO(+RR)_C220S_IgG1_G236R/L328R Heavy chain 1 (empty-Fc(216)_IgG1_pI_ISO(-)_G236R/L328R): (SEQ ID NO: 85)

EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPG

Heavy chain 2 (Anti-TAC_H1.8L1_scFv_Fc(216)_IgG1_pI_ISO(+RR)_G236R/L328R):

(SEQ ID NO: 86)

QVQLVQSGAEVKKPGASVKVSCKASGYTFT<u>SYRMH</u>WVRQAPGQGLEWMG<u>WINPSTGYTEY
NQKFQG</u>RVTITADKSISTAYMELSRLRSDDTAVYYCAR<u>GGGVFDY</u>WGQGTLVTVSSGGGGSG
GGGSGGGGSGGGGSQIVLTQSPATLSLSPGERATLSC<u>RASSSISYMH</u>WFQQKPGQSPQLLIY
<u>TTSNLAS</u>GVPARFSGSGSGTDYTLTISSLQPEDFAVYYC<u>HQRSTYPLT</u>FGSGTKLEIKERKSSD
KTHTCPRCPAPELLRGPSVFLFPPKPKDTLMISRTPEVTCVVVDVSHEDPEVKFKWYVDGVEV
HNAKTKPREEQYNSTYRVVSVLTVLHQDWLNGKEYKCKVSNKARPAPIEKTISKAKGQPREPQ
VYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Figure 31A

13730 - hIL2-Ibalizumab_H0L0_IgG1_PVA_/S267K_IgG1_C220S/S364K/E357Q-pI(-)_Isosteric_A_L368D/K370S Heavy chain 1 (hIL2_IgG1_C220S/PVA_/S267K/S364K/E357Q): (SEQ ID NO: 87)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (Ibalizumab_H0_IgG1_pI(-)_Isosteric_A_PVA_/S267K/L368D/K370S):

(SEQ ID NO: 88)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSAS
TKGPSVFPLAPSSKSTSGGTAALGCLVKDYFPEPVTVSWNSGALTSGVHTFPAVLQSSGLYSL
SSVVTVPSSSLGTQTYICNVNHKPSDTKVDKKVEPKSCDKTHTCPPCPAPPVAGPSVFLFPPK
PKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHN
HYTQKSLSLSPGK

Light chain (Ibalizumab_L0) (SEQ ID NO: 89)

DIVMTQSPDSLAVSLGERVTMNC<u>KSSQSLLYSTNQKNYLA</u>WYQQKPGQSPKLLIY<u>WASTRES</u>
GVPDRFSGSGSGTDFTLTISSVQAEDVAVYYC<u>QQYYSYRT</u>FGGGTKLEIKRTVAAPSVFIFPPS
DEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Figure 31B

13731 - hIL2-OKT4A_H1L1_IgG1_PVA_/S267K_IgG1_C220S/S364K/E357Q-pI(-)_Isosteric_A_L368D/K370S Heavy chain 1 (hIL2_IgG1_C220S/PVA_/S267K/S364K/E357Q): (SEQ ID NO: 90)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (OKT4A_H1_IgG1_pI(-)_Isosteric_A_PVA_/S267K/L368D/K370S):

(SEQ ID NO: 91)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYICNVNHKPSDTKVDKKVEPKSCDKTHTCPPCPAPPVAGPSVFLFPPKPK
DTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHY
TQKSLSLSPGK

Light chain (OKT4A_L1): (SEQ ID NO: 92)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31C

13732 - OKT4A_H1L1_Fab-Anti-TAC_H1L1_scFv_(GGGGS)4_IgG1_PVA_/S267K_IgG1_pI(-)_Isosteric_A_L368D/K370S_IgG1_C220S/S364K/E357Q Heavy chain 1 (OKT4A_H1_IgG1_pI(-)_Isosteric_A_PVA_/S267K/L368D/K370S):

(SEQ ID NO: 93)

EVQLVESGGGLVQPGGSLRLSCAASGFTFS<u>NYAMS</u>WVRQAPGKRLEWVS<u>AISDHSTNTYYPD
SVKG</u>RFTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYICNVNHKPSDTKVDKKVEPKSCDKTHTCPPCPAPPVAGPSVFLFPPKPK
DTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHY
TQKSLSLSPGK

Heavy chain 2 (Anti-TAC_H1L1_scFv(GGGGS)4_Fc(216)_IgG1_C220S/PVA_/S267K/S364K/E357Q):

(SEQ ID NO: 94)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT
SNLA</u>SGVPARFSGSGSGTDYTLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Light chain (OKT4A_L1): (SEQ ID NO: 95)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31D

13734 - Ibalizumab_H0L0_Fab-Anti-
TAC_H1L1_scFv_(GGGGS)4_IgG1_PVA_/S267K_IgG1_pI(-
)_Isosteric_A_L368D/K370S_IgG1_C220S/S364K/E357Q Heavy chain 1 (Ibalizumab_H0_IgG1_pI(-)_Isosteric_A_PVA_/S267K/L368D/K370S):

(SEQ ID NO: 96)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSAS
TKGPSVFPLAPSSKSTSGGTAALGCLVKDYFPEPVTVSWNSGALTSGVHTFPAVLQSSGLYSL
SSVVTVPSSSLGTQTYICNVNHKPSDTKVDKKVEPKSCDKTHTCPPCPAPPVAGPSVFLFPPK
PKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHN
HYTQKSLSLSPGK

Heavy chain 2 (Anti-
TAC_H1L1_scFv(GGGGS)4_Fc(216)_IgG1_C220S/PVA_/S267K/S364K/E357Q):

(SEQ ID NO: 97)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Light chain (Ibalizumab_L0): (SEQ ID NO: 98)

DIVMTQSPDSLAVSLGERVTMNC<u>KSSQSLLYSTNQKNYLA</u>WYQQKPGQSPKLLIY<u>WASTRES</u>
GVPDRFSGSGSGTDFTLTISSVQAEDVAVYYC<u>QQYYSYRT</u>FGGGTKLEIKRTVAAPSVFIFPPS
DEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Figure 31E

13637 - hIL2_0.1_OKT4A_H1L1_IgG1_pI_ISO(-/+RR)_C220S_G236R/L328R

Heavy chain 1 (hIL2_0.1_IgG1_pI_ISO(-)_C220S/G236R/L328R): (SEQ ID NO: 99)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPG

Heavy chain 2 (OKT4A_H1_IgG1_pI_ISO(+RR)_G236R/L328R): (SEQ ID NO: 100)

EVQLVESGGGLVQPGGSLRLSCAASGFTFS<u>NYAMS</u>WVRQAPGKRLEWVS<u>AISDHSTNTYYPD
SVKG</u>RFTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 101)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31F

13638 - hIL2_0.2_OKT4A_H1L1_IgG1_pI_ISO(-/+RR)_C220S_G236R/L328R

Heavy chain 1 (hIL2_0.2_IgG1_pI_ISO(-)_C220S/G236R/L328R): (SEQ ID NO: 102)

APASSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFSQSIISTLT
GPSVFLFPPKPKDTLMISRTPEVTCVVVDVSHEDPEVQFNWYVDGVEVHNAKTKPREEQYNST
YRVVSVLTVLHQDWLNGKEYKCKVSNKARPAPIEKTISKAKGQPREPQVYTLPPSQEEMTKNQ
VSLTCLVKGFYPSDIAVEWESSGQPENNYNTTPPMLDSDGSFFLYSKLTVDKSRWQEGNVFS
CSVMHEALHNHYTQKSLSLSPG

Heavy chain 2 (OKT4A_H1_IgG1_pI_ISO(+RR)_G236R/L328R): (SEQ ID NO: 103)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 104)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31G

13639 - hIL2_0.3_OKT4A_H1L1_IgG1_pI_ISO(-/+RR)_C220S_G236R/L328R

Heavy chain 1 (hIL2_0.3_IgG1_pI_ISO(-)_C220S/G236R/L328R): (SEQ ID NO: 105)

APASSSTKKTQLQLEHLLLDLQMILNGINNYKNPKLTRMLTAKFAMPKKATELKHLQCLEEELKP
LEEVLNGAQSKNFHLRPRDLISNINVIVLELKGSETTFMCEYADETATIVEFLNRWITFAQSIISTL
TGPSVFLFPPKPKDTLMISRTPEVTCVVVDVSHEDPEVQFNWYVDGVEVHNAKTKPREEQYNS
TYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVF
SCSVMHEALHNHYTQKSLSLSPG

Heavy chain 2 (OKT4A_H1_IgG1_pI_ISO(+RR)_G236R/L328R): (SEQ ID NO: 106)

EVQLVESGGGLVQPGGSLRLSCAASGFTFSNYAMSWVRQAPGKRLEWVSAISDHSTNTYYPD
SVKGRFTISRDNAKNTLYLQMNSLRAEDTAVYYCARKYGGDYDPFDYWGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 107)

DIQMTQSPSSLSASVGDRVTITCQASQDINNYIAWYQHKPGKGPKLLIHYTSTLQPGIPSRFSGS
GSGRDYTLTISSLQPEDFATYYCLQYDNLLFTFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31H

13640 - hIL2_0.4_OKT4A_H1L1_IgG1_pI_ISO(-/+RR)_C220S_G236R/L328R

Heavy chain 1 (hIL2_0.4_IgG1_pI_ISO(-)_C220S/G236R/L328R): (SEQ ID NO: 108)

APTSSSTKKTQLQLEHLLLDLQMILNGISNHKNPRLARMLTFKFYMPEKATELKHLQCLEEELKP
LEEALRLAPSKNFHLRPRDLISDVNVIVLELKGSETTFMCEYADETATIVEFLNRWITFSQSIISTL
TGPSVFLFPPKPKDTLMISRTPEVTCVVVDVSHEDPEVQFNWYVDGVEVHNAKTKPREEQYNS
TYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVF
SCSVMHEALHNHYTQKSLSLSPG

Heavy chain 2 (OKT4A_H1_IgG1_pI_ISO(+RR)_G236R/L328R): (SEQ ID NO: 109)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 110)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31I

13641 - hIL2_0.5_OKT4A_H1L1_IgG1_pI_ISO(-/+RR)_C220S_G236R/L328R

Heavy chain 1 (hIL2_0.5_IgG1_pI_ISO(-)_C220S/G236R/L328R):

(SEQ ID NO: 111)

APTSSSTKKTQLQLEHLLLDLQMILNGINNYKNPKLTRMLTFKFYMPKKATELKHLQCLEEELKP
LEEALNLAPSKNFHLRPRDLISNINVIVLELKGSETTFMCEYADETATIVEFLNRWITFSQSTISTL
TGPSVFLFPPKPKDTLMISRTPEVTCVVVDVSHEDPEVQFNWYVDGVEVHNAKTKPREEQYNS
TYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVF
SCSVMHEALHNHYTQKSLSLSPG

Heavy chain 2 (OKT4A_H1_IgG1_pI_ISO(+RR)_G236R/L328R): (SEQ ID NO: 112)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 113)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31J

13642 - hIL2_0.6_OKT4A_H1L1_IgG1_pI_ISO(-/+RR)_C220S_G236R/L328R

Heavy chain 1 (hIL2_0.6_IgG1_pI_ISO(-)_C220S/G236R/L328R): (SEQ ID NO: 114)

APTSSSTKKTQLQLEHLLLDLQMILNGISNHKNPRLARMLTFKFYMPEKATELKHLQCLEEELKP
LEEALRLAPSKNFHLRPRDLISDVNVIVLELKGSETTFMCEYADETATIVEFLNRWITFSTSIISTL
TGPSVFLFPPKPKDTLMISRTPEVTCVVVDVSHEDPEVQFNWYVDGVEVHNAKTKPREEQYNS
TYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVF
SCSVMHEALHNHYTQKSLSLSPG

Heavy chain 2 (OKT4A_H1_IgG1_pI_ISO(+RR)_G236R/L328R): (SEQ ID NO: 115)

EVQLVESGGGLVQPGGSLRLSCAASGFTFS<u>NYAMS</u>WVRQAPGKRLEWVS<u>AISDHSTNTYYPD
SVKG</u>RFTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 116)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31K

13643 - hIL2_0.7_OKT4A_H1L1_IgG1_pI_ISO(-/+RR)_C220S_G236R/L328R

Heavy chain 1 (hIL2_0.7_IgG1_pI_ISO(-)_C220S/G236R/L328R): (SEQ ID NO: 117)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFSTSIISTLT
GPSVFLFPPKPKDTLMISRTPEVTCVVVDVSHEDPEVQFNWYVDGVEVHNAKTKPREEQYNST
YRVVSVLTVLHQDWLNGKEYKCKVSNKARPAPIEKTISKAKGQPREPQVYTLPPSQEEMTKNQ
VSLTCLVKGFYPSDIAVEWESSGQPENNYNTTPPMLDSDGSFFLYSKLTVDKSRWQEGNVFS
CSVMHEALHNHYTQKSLSLSPG

Heavy chain 2 (OKT4A_H1_IgG1_pI_ISO(+RR)_G236R/L328R): (SEQ ID NO: 118)

EVQLVESGGGLVQPGGSLRLSCAASGFTFSNYAMSWVRQAPGKRLEWVSAISDHSTNTYYPD
SVKGRFTISRDNAKNTLYLQMNSLRAEDTAVYYCARKYGGDYDPFDYWGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 119)

DIQMTQSPSSLSASVGDRVTITCQASQDINNYIAWYQHKPGKGPKLLIHYTSTLQPGIPSRFSGS
GSGRDYTLTISSLQPEDFATYYCLQYDNLLFTFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31L

13644 - hIL2_0.8_OKT4A_H1L1_IgG1_pI_ISO(-/+RR)_C220S_G236R/L328R

Heavy chain 1 (hIL2_0.8_IgG1_pI_ISO(-)_C220S/G236R/L328R): (SEQ ID NO: 120)

APTSSSTKKTQLQLEHLLLDLQMILNGINNYKNPKLTRMLTFKFYMPKKATELKHLQCLEEELKP
LEEVLNLAQSKNFHLRPRDLISRINVIVLELKGSETTFMCEYADETATIVEFLNRWITFSQSIISTLT
GPSVFLFPPKPKDTLMISRTPEVTCVVVDVSHEDPEVQFNWYVDGVEVHNAKTKPREEQYNST
YRVVSVLTVLHQDWLNGKEYKCKVSNKARPAPIEKTISKAKGQPREPQVYTLPPSQEEMTKNQ
VSLTCLVKGFYPSDIAVEWESSGQPENNYNTTPPMLDSDGSFFLYSKLTVDKSRWQEGNVFS
CSVMHEALHNHYTQKSLSLSPG

Heavy chain 2 (OKT4A_H1_IgG1_pI_ISO(+RR)_G236R/L328R): (SEQ ID NO: 121)

EVQLVESGGGLVQPGGSLRLCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 122)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31M

13726 - mAb1567_H0L0_IgG1

Heavy chain (mAb1567_H0_IgG1): (SEQ ID NO: 123)

QVQLQQSGPELVRPGASVRISCKASGYTFASYYIQWMKQRPGQGLEWIGWINPGNVNTKYNE
KFKGKATLTADKSSTTAYMQLSSLTSEDSAVYFCARSTYYRPLDYWGQGTTVTVSSASTKGPS
VFPLAPSSKSTSGGTAALGCLVKDYFPEPVTVSWNSGALTSGVHTFPAVLQSSGLYSLSSVVT
VPSSSLGTQTYICNVNHKPSNTKVDKKVEPKSCDKTHTCPPCPAPELLGGPSVFLFPPKPKDTL
MISRTPEVTCVVVDVSHEDPEVKFNWYVDGVEVHNAKTKPREEQYNSTYRVVSVLTVLHQDW
LNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQ
KSLSLSPGK

Light chain (mAb1567_L0): (SEQ ID NO: 124)

DIELTQSPSSLAVSAGEKVTMSCKSSQSILYSSNQKNYLAWYQQKPGQSPKLLIYWASTRESG
VPDRFTGSGSGTDFTLTISSVQAEDLAVYYCHQYLSSYTFGGGTKLEIKRTVAAPSVFIFPPSDE
QLKSGTASVVCLLNNFYPREAKVQWKVDNALQSGNSQESVTEQDSKDSTYSLSSTLTLSKADY
EKHKVYACEVTHQGLSSPVTKSFNRGEC

Figure 31N

10010 - Ipilimumab_H0L0_IgG1

Heavy chain (Ipilimumab_H0_IgG1): (SEQ ID NO: 125)

QVQLVESGGGVVQPGRSLRLSCAASGFTFS<u>SYTMH</u>WVRQAPGKGLEWVT<u>FISYDGNNKYYA
DSVKG</u>RFTISRDNSKNTLYLQMNSLRAEDTAIYYCAR<u>TGWLGPFDY</u>WGQGTLVTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSNTKVDKKVEPKSCDKTHTCPPCPAPELLGGPSVFLFPPKPKDT
LMISRTPEVTCVVVDVSHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYT
QKSLSLSPGK

Light chain (Ipilimumab_L0): (SEQ ID NO: 126)

EIVLTQSPGTLSLSPGERATLSC<u>RASQSVGSSYLA</u>WYQQKPGQAPRLLIY<u>GAFSRAT</u>GIPDRFS
GSGSGTDFTLTISRLEPEDFAVYYC<u>QQYGSSPWT</u>FGQGTKVEIKRTVAAPSVFIFPPSDEQLKS
GTASVVCLLNNFYPREAKVQWKVDNALQSGNSQESVTEQDSKDSTYSLSSTLTLSKADYEKH
KVYACEVTHQGLSSPVTKSFNRGEC

Figure 31O

13765 - hIL2_OKT4A_H1L1-IgG1_C220S/PVA_/S267K/S364K/E357Q-IgG1_pI(-)_Isosteric_A_PVA_/S267K/L368D/K370S Heavy chain 1 (hIL2_IgG1_C220S/PVA_/S267K/S364K/E357Q): (SEQ ID NO: 127)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (OKT4A_H1_IgG1_pI(-)_Isosteric_A_PVA_/S267K/L368D/K370S):

(SEQ ID NO: 128)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYICNVNHKPSDTKVDKKVEPKSCDKTHTCPPCPAPPVAGPSVFLFPPKPK
DTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHY
TQKSLSLSPGK

Light chain (OKT4A_L1): (SEQ ID NO: 129)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31P

13766 - hIL2_Ibalizumab_H0L0-IgG1_C220S/PVA_/S267K/S364K/E357Q-IgG1_pI(-)_Isosteric_A_PVA_/S267K/L368D/K370S Heavy chain 1 (hIL2_IgG1_C220S/PVA_/S267K/S364K/E357Q): (SEQ ID NO: 130)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (Ibalizumab_H0_IgG1_pI(-)_Isosteric_A_PVA_/S267K/L368D/K370S):
(SEQ ID NO: 131)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSAS
TKGPSVFPLAPSSKSTSGGTAALGCLVKDYFPEPVTVSWNSGALTSGVHTFPAVLQSSGLYSL
SSVVTVPSSSLGTQTYICNVNHKPSDTKVDKKVEPKSCDKTHTCPPCPAPPVAGPSVFLFPPK
PKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHN
HYTQKSLSLSPGK

Light chain (Ibalizumab_L0): (SEQ ID NO: 132)

DIVMTQSPDSLAVSLGERVTMNC<u>KSSQSLLYSTNQKNYLA</u>WYQQKPGQSPKLLIY<u>WASTRES</u>
GVPDRFSGSGSGTDFTLTISSVQAEDVAVYYC<u>QQYYSYRT</u>FGGGTKLEIKRTVAAPSVFIFPPS
DEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Figure 31Q

13767 - OKT4A_H1L1_Anti-TAC_H1L1_scFv(GKPGS)4-IgG1_pI(-
)_Isosteric_A_PVA_/S267K/L368D/K370S-Fc(216)_IgG1_C220S/PVA_/S267K/S364K/E357Q Heavy chain 1 (OKT4A_H1_IgG1_pI(-)_Isosteric_A_PVA_/S267K/L368D/K370S):

(SEQ ID NO: 133)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYICNVNHKPSDTKVDKKVEPKSCDKTHTCPPCPAPPVAGPSVFLFPPKPK
DTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHY
TQKSLSLSPGK

Heavy chain 2 (Anti-
TAC_H1L1_scFv(GKPGS)4_Fc(216)_IgG1_C220S/PVA_/S267K/S364K/E357Q):

(SEQ ID NO: 134)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGKPGSGK
PGSGKPGSGKPGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Light chain (OKT4A_L1): (SEQ ID NO: 135)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31R

13768 - Ibalizumab_H0L0_Anti-TAC_H1L1_scFv(GKPGS)4-IgG1_pI(-)_Isosteric_A_PVA_/S267K/L368D/K370S-Fc(216)_IgG1_C220S/PVA_/S267K/S364K/E357Q Heavy chain 1 (Ibalizumab_H0_IgG1_pI(-)_Isosteric_A_PVA_/S267K/L368D/K370S):

(SEQ ID NO: 136)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSAS
TKGPSVFPLAPSSKSTSGGTAALGCLVKDYFPEPVTVSWNSGALTSGVHTFPAVLQSSGLYSL
SSVVTVPSSSLGTQTYICNVNHKPSDTKVDKKVEPKSCDKTHTCPPCPAPPVAGPSVFLFPPK
PKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHN
HYTQKSLSLSPGK

Heavy chain 2 (Anti-TAC_H1L1_scFv(GKPGS)4_Fc(216)_IgG1_C220S/PVA_/S267K/S364K/E357Q):

(SEQ ID NO: 137)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLSDDTAVYYCAR<u>GGGVFDY</u>WGQGTLVTVSSGKPGSGK
PGSGKPGSGKPGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Light chain (Ibalizumab_L0): (SEQ ID NO: 138)

DIVMTQSPDSLAVSLGERVTMNC<u>KSSQSLLYSTNQKNYLA</u>WYQQKPGQSPKLLIY<u>WASTRES</u>
GVPDRFSGSGSGTDFTLTISSVQAEDVAVYYC<u>QQYYSYRT</u>FGGGTKLEIKRTVAAPSVFIFPPS
DEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Figure 31S

13769 - empty-Fc(216)_Anti-TAC_H1L1_scFv(GKPGS)4-IgG1_pI(-
)_Isosteric_A_C220S/PVA_/S267K/L368D/K370S-
Fc(216)_IgG1_C220S/PVA_/S267K/S364K/E357Q Heavy chain 1 (empty-Fc(216)_IgG1_pI(-)_Isosteric_A_C220S/PVA_/S267K/L368D/K370S):

(SEQ ID NO: 139)

EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Heavy chain 2 (Anti-
TAC_H1L1_scFv(GKPGS)4_Fc(216)_IgG1_C220S/PVA_/S267K/S364K/E357Q):

(SEQ ID NO: 140)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGKPGSGK
PGSGKPGSGKPGSQIVLTQSPATLSLSPGERATLSC<u>RASSSISYMH</u>WFQQKPGQSPQLLIY<u>TT
SNLAS</u>GVPARFSGSGSGTDYLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Figure 31T

13770 - hIL2_empty-Fc(216)-IgG1_C220S/PVA_/S267K/S364K/E357Q-IgG1_pI(-)_Isosteric_A_C220S/PVA_/S267K/L368D/K370S Heavy chain 1 (hIL2_IgG1_C220S/PVA_/S267K/S364K/E357Q):

(SEQ ID NO: 141)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (empty-Fc(216)_IgG1_pI(-)_Isosteric_A_C220S/PVA_/S267K/L368D/K370S):

(SEQ ID NO: 142)

EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Figure 31U

13771 - Ibalizumab_H0L0_empty-Fc(216)-IgG1_pI(-)_Isosteric_A_PVA_/S267K/L368D/K370S-IgG1_C220S/PVA_/S267K/S364K/E357Q Heavy chain 1 (Ibalizumab_H0_IgG1_pI(-)_Isosteric_A_PVA_/S267K/L368D/K370S):

(SEQ ID NO: 143)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSAS
TKGPSVFPLAPSSKSTSGGTAALGCLVKDYFPEPVTVSWNSGALTSGVHTFPAVLQSSGLYSL
SSVVTVPSSSLGTQTYICNVNHKPSDTKVDKKVEPKSCDKTHTCPPCPAPPVAGPSVFLFPPK
PKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHN
HYTQKSLSLSPGK

Heavy chain 2 (empty-Fc(216)_IgG1_C220S/PVA_/S267K/S364K/E357Q): (SEQ ID NO: 144)

EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Light chain (Ibalizumab_L0): (SEQ ID NO: 145)

DIVMTQSPDSLAVSLGERVTMNC<u>KSSQSLLYSTNQKNYLA</u>WYQQKPGQSPKLLIY<u>WASTRES</u>
GVPDRFSGSGSGTDFTLTISSVQAEDVAVYYC<u>QQYYSYRT</u>FGGGTKLEIKRTVAAPSVFIFPPS
DEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Figure 31V

13772 - OKT4A_H1L1_empty-Fc(216)-IgG1_pI(-)_Isosteric_A_PVA_/S267K/L368D/K370S-IgG1_C220S/PVA_/S267K/S364K/E357Q Heavy chain 1 (OKT4A_H1_IgG1_pI(-)_Isosteric_A_PVA_/S267K/L368D/K370S):

(SEQ ID NO: 146)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYICNVNHKPSDTKVDKKVEPKSCDKTHTCPPCPAPPVAGPSVFLFPPKPK
DTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHY
TQKSLSLSPGK

Heavy chain 2 (empty-Fc(216)_IgG1_C220S/PVA_/S267K/S364K/E357Q): (SEQ ID NO: 147)

EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Light chain (OKT4A_L1): (SEQ ID NO: 148)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31W

13773 - mAb1567_H0L0-Anti-TAC_H1L1_scFv(GKPGS)4_IgG1_pI(-)_Isosteric_A_PVA_/S267K/L368D/K370S-Fc(216)_IgG1_C220S/PVA_/S267K/S364K/E357Q Heavy chain 1 (mAb1567_H0_IgG1_pI(-)_Isosteric_A_PVA_/S267K/L368D/K370S):

(SEQ ID NO: 149)

QVQLQQSGPELVRPGASVRISCKASGYTFA<u>SYYIQ</u>WMKQRPGQGLEWIG<u>WINPGNVNTKYNE
KFKG</u>KATLTADKSSTTAYMQLSSLTSEDSAVYFCAR<u>STYYRPLDY</u>WGQGTTVTVSSASTKGPS
VFPLAPSSKSTSGGTAALGCLVKDYFPEPVTVSWNSGALTSGVHTFPAVLQSSGLYSLSSVVT
VPSSSLGTQTYICNVNHKPSDTKVDKKVEPKSCDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQ
KSLSLSPGK

Heavy chain 2 (Anti-TAC_H1L1_scFv(GKPGS)4_Fc(216)_IgG1_C220S/PVA_/S267K/S364K/E357Q):

(SEQ ID NO: 150)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGKPGSGK
PGSGKPGSGKPGSQIVLTQSPATLSLSPGERATLSC<u>RASSSISYMH</u>WFQQKPGQSPQLLIY<u>TT
SNLAS</u>GVPARFSGSGSGTDYLTISSLQPEDFAVYYC<u>HQRSTYPLT</u>FGSGTKLEIKEPKSSDKT
HTCPPCPAPPVAGPSVFLFPPKPKDLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Light chain (mAb1567_L0): (SEQ ID NO: 151)

DIELTQSPSSLAVSAGEKVTMSC<u>KSSQSILYSSNQKNYLA</u>WYQQKPGQSPKLLIY<u>WASTRESG</u>
VPDRFTGSGSGTDFTLTISSVQAEDLAVYYC<u>HQYLSSYT</u>FGGGTKLEIKRTVAAPSVFIFPPSDE
QLKSGTASVVCLLNNFYPREAKVQWKVDNALQSGNSQESVTEQDSKDSTYSLSSTLTLSKADY
EKHKVYACEVTHQGLSSPVTKSFNRGEC

Figure 31X

13774 - mAb1567_H0L0-empty-
Fc(216)_IgG1_pI_ISO(+RR)_C220S/PVA_/S267K/S364K/E357Q-IgG1_pI(-
)_Isosteric_A_C220S/PVA_/S267K/L368D/K370S Heavy chain 1 (mAb1567_H0_IgG1_pI_ISO(+RR)_C220S/PVA_/S267K/S364K/E357Q):

(SEQ ID NO: 152)

QVQLQQSGPELVRPGASVRISCKASGYTFA<u>SYYIQ</u>WMKQRPGQGLEWIG<u>WINPGNVNTKYNE
KFKG</u>KATLTADKSSTTAYMQLSSLTSEDSAVYFCAR<u>STYYRPLDY</u>WGQGTTVTVSSASTKGPS
VFPLAPSSKSTSGGTAALGCLVKDYFPEPVTVSWNSGALTSGVHTFPAVLQSSGLYSLSSVVT
VPSSSLGTKTYTCNVNHKPSNTKVDKKVERKSCDKTHTCPRCPAPPVAGPSVFLFPPKPKDTL
MISRTPEVTCVVVDVKHEDPEVKFKWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQ
KSLSLSPGK

Heavy chain 2 (empty-Fc(216)_IgG1_pI(-)_Isosteric_A_C220S/PVA_/S267K/L368D/K370S):

(SEQ ID NO: 153)

EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Light chain (mAb1567_L0): (SEQ ID NO: 154)

DIELTQSPSSLAVSAGEKVTMSC<u>KSSQSILYSSNQKNYLA</u>WYQQKPGQSPKLLIY<u>WASTRESG</u>
VPDRFTGSGSGTDFTLTISSVQAEDLAVYYC<u>HQYLSSYT</u>FGGGTKLEIKRTVAAPSVFIFPPSDE
QLKSGTASVVCLLNNFYPREAKVQWKVDNALQSGNSQESVTEQDSKDSTYSLSSTLTLSKADY
EKHKVYACEVTHQGLSSPVTKSFNRGEC

Figure 31Y

13775 - Ipilimumab_H0L0-Anti-TAC_H1L1_scFv(GKPGS)4_IgG1_pI(-)_Isosteric_A_PVA_/S267K/L368D/K370S-Fc(216)_IgG1_C220S/PVA_/S267K/S364K/E357Q Heavy chain 1 (Ipilimumab_H0_IgG1_pI(-)_Isosteric_A_PVA_/S267K/L368D/K370S):

(SEQ ID NO: 155)

QVQLVESGGGVVQPGRSLRLSCAASGFTFS<u>SYTMH</u>WVRQAPGKGLEWVT<u>FISYDGNNKYYA
DSVKG</u>RFTISRDNSKNTLYLQMNSLRAEDTAIYYCAR<u>TGWLGPFDY</u>WGQGTLVTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQ
KSLSLSPGK

Heavy chain 2 (Anti-TAC_H1L1_scFv(GKPGS)4_Fc(216)_IgG1_C220S/PVA_/S267K/S364K/E357Q):

(SEQ ID NO: 156)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGKPGSGK
PGSGKPGSGKPGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Light chain (Ipilimumab_L0): (SEQ ID NO: 157)

EIVLTQSPGTLSLSPGERATLSC<u>RASQSVGSSYLA</u>WYQQKPGQAPRLLIY<u>GAFSRAT</u>GIPDRFS
GSGSGTDFTLTISRLEPEDFAVYYC<u>QQYGSSPWT</u>FGQGTKVEIKRTVAAPSVFIFPPSDEQLKS
GTASVVCLLNNFYPREAKVQWKVDNALQSGNSQESVTEQDSKDSTYSLSSTLTLSKADYEKH
KVYACEVTHQGLSSPVTKSFNRGEC

Figure 31Z

13776 - Ipilimumab_H0L0-empty-Fc(216)_IgG1_pI(-)_Isosteric_A_PVA_/S267K/L368D/K370S-IgG1_C220S/PVA_/S267K/S364K/E357Q Heavy chain 1 (Ipilimumab_H0_IgG1_pI(-)_Isosteric_A_PVA_/S267K/L368D/K370S):

(SEQ ID NO: 158)

QVQLVESGGGVVQPGRSLRLSCAASGFTFS<u>SYTMH</u>WVRQAPGKGLEWVT<u>FISYDGNNKYYA
DSVK</u>GRFTISRDNSKNTLYLQMNSLRAEDTAIYYCART<u>GWLGPFDY</u>WGQGTLVTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQ
KSLSLSPGK

Heavy chain 2 (empty-Fc(216)_IgG1_C220S/PVA_/S267K/S364K/E357Q): (SEQ ID NO: 159)

EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Light chain (Ipilimumab_L0): (SEQ ID NO: 160)

EIVLTQSPGTLSLSPGERATLSC<u>RASQSVGSSYLA</u>WYQQKPGQAPRLLIY<u>GAFSRAT</u>GIPDRFS
GSGSGTDFTLTISRLEPEDFAVYYC<u>QQYGSSPWT</u>FGQGTKVEIKRTVAAPSVFIFPPSDEQLKS
GTASVVCLLNNFYPREAKVQWKVDNALQSGNSQESVTEQDSKDSTYSLSSTLTLSKADYEKH
KVYACEVTHQGLSSPVTKSFNRGEC

Figure 31AA

13777 - Ipilimumab_H0L0-empty-
Fc(216)_IgG1_pI_ISO(+RR)_C220S/PVA_/S267K/S364K/E357Q-IgG1_pI(-
)_Isosteric_A_C220S/PVA_/S267K/L368D/K370S Heavy chain 1 (Ipilimumab_H0_IgG1_pI_ISO(+RR)_C220S/PVA_/S267K/S364K/E357Q):

(SEQ ID NO: 161)

QVQLVESGGGVVQPGRSLRLSCAASGFTFS<u>SYTMH</u>WVRQAPGKGLEWVT<u>FISYDGNNKYYA
DSVKG</u>RFTISRDNSKNTLYLQMNSLRAEDTAIYYCAR<u>TGWLGPFDY</u>WGQGTLVTVSSASTKGP
SVFPLAPSSKSTSGGTAALGCLVKDYFPEPVTVSWNSGALTSGVHTFPAVLQSSGLYSLSSVV
TVPSSSLGTKTYTCNVNHKPSNTKVDKKVERKSCDKTHTCPRCPAPPVAGPSVFLFPPKPKDT
LMISRTPEVTCVVVDVKHEDPEVKFKWYVDGVEVHNAKTKPREEQYNSTYRVVSVLTVLHQD
WLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYT
QKSLSLSPGK

Heavy chain 2 (empty-Fc(216)_IgG1_pI(-)_Isosteric_A_C220S/PVA_/S267K/L368D/K370S):

(SEQ ID NO: 162)

EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Light chain (Ipilimumab_L0): (SEQ ID NO: 163)

EIVLTQSPGTLSLSPGERATLSC<u>RASQSVGSSYLA</u>WYQQKPGQAPRLLIY<u>GAFSRAT</u>GIPDRFS
GSGSGTDFTLTISRLEPEDFAVYYC<u>QQYGSSPWT</u>FGQGTKVEIKRTVAAPSVFIFPPSDEQLKS
GTASVVCLLNNFYPREAKVQWKVDNALQSGNSQESVTEQDSKDSTYSLSSTLTLSKADYEKH
KVYACEVTHQGLSSPVTKSFNRGEC

Figure 31BB

13030 - empty-Fc(216)_OKT4A_H1L1_IgG1_pI_ISO(-/+RR)_G236R/L328R_(G4S)2_hIL2(1)

Heavy chain 1 (empty-Fc(216)_IgG1_pI_ISO(-)_C220S/G236R/L328R_(G4S)2_hIL2_fusion):

(SEQ ID NO: 164)

EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPGKGGGGSGGGGSAPTSSST
KKTQLQLEHLLLDLQMILNGINNYKNPKLTRMLTFKFYMPKKATELKHLQCLEEELKPLEEVLNL
AQSKNFHLRPRDLISNINVIVLELKGSETTFMCEYADETATIVEFLNRWITFCQSIISTLT

Heavy chain 2 (OKT4A_H1_IgG1_pI_ISO(+RR)_G236R/L328R): (SEQ ID NO: 165)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 166)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31CC

13034 - hIL2_Fc(216)_OKT4A_H1L1_IgG1_pI_ISO(-/+RR)_C220S/G236R/L328R_(G4S)2_hIL2(1)

Heavy chain 1 (hIL2_Fc(216)_IgG1_pI_ISO(-)_C220S/G236R/L328R_(G4S)2_hIL2_fusion):

(SEQ ID NO: 167)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPGKGGGGSGGGGSAPTSSST
KKTQLQLEHLLLDLQMILNGINNYKNPKLTRMLTFKFYMPKKATELKHLQCLEEELKPLEEVLNL
AQSKNFHLRPRDLISNINVIVLELKGSETTFMCEYADETATIVEFLNRWITFCQSIISTLT

Heavy chain 2 (OKT4A_H1_IgG1_pI_ISO(+RR)_G236R/L328R): (SEQ ID NO: 168)

EVQLVESGGGLVQPGGSLRLSCAASGFTFS<u>NYAMS</u>WVRQAPGKRLEWVS<u>AISDHSTNTYYPD
SVKG</u>RFTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 169)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31DD

13035 - OKT4A_H1L1_IgG1_pI_ISO(-/+RR)_G236R/L328R_hIL2(1)

Heavy chain 1 (OKT4A_H1_IgG1_pI_ISO(-)_G236R/L328R_hIL2): (SEQ ID NO: 170)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCARKYGGDYDPFDYWGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYTCNVDHKPSNTKVDKKVEPKSCDKTHTCPPCPAPELLRGPSVFLFPPKP
KDTLMISRTPEVTCVVVDVSHEDPEVQFNWYVDGVEVHNAKTKPREEQYNSTYRVVSVLTVLH
QDWLNGKEYKCKVSNKARPAPIEKTISKAKGQPREPQVYTLPPSQEEMTKNQVSLTCLVKGFY
PSDIAVEWESSGQPENNYNTTPPMLDSDGSFFLYSKLTVDKSRWQEGNVFSCSVMHEALHNH
YTQKSLSLSPGKGGGSGGGGSAPTSSSTKKTQLQLEHLLLDLQMILNGINNYKNPKLTRMLT
FKFYMPKKATELKHLQCLEEELKPLEEVLNLAQSKNFHLRPRDLISNINVIVLELKGSETTFMCEY
ADETATIVEFLNRWITFCQSIISTLT

Heavy chain 2 (OKT4A_H1_IgG1_pI_ISO(+RR)_G236R/L328R): (SEQ ID NO: 171)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGK

Light chain (OKT4A_L1): (SEQ ID NO: 172)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31EE

13045 - empty-Fc(216)_OKT4A_H1L1_IgG1_pI_ISO(-/WT)_G236R/L328R_(G4S)2_hIL2(2)

Heavy chain 1 (empty-Fc(216)_IgG1_pI_ISO(-)_C220S/G236R/L328R_(G4S)2_hIL2_fusion):

(SEQ ID NO: 173)

EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPGKGGGGSGGGGSAPTSSST
KKTQLQLEHLLLDLQMILNGINNYKNPKLTRMLTFKFYMPKKATELKHLQCLEEELKPLEEVLNL
AQSKNFHLRPRDLISNINVIVLELKGSETTFMCEYADETATIVEFLNRWITFCQSIISTLT

Heavy chain 2 (OKT4A_H1_IgG1_G236R/L328R_hIL2): (SEQ ID NO: 174)

EVQLVESGGGLVQPGGSLRLSCAASGFTFS<u>NYAMS</u>WVRQAPGKRLEWVS<u>AISDHSTNTYYPD
SVKGR</u>FTISRDNAKNTLYLQMNSLRAEDTAVYYCAR<u>KYGGDYDPFDY</u>WGQGTLVTVSSASTK
GPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLRGPSVFLFPPKPK
DTLMISRTPEVTCVVVDVSHEDPEVKFNWYVDGVEVHNAKTKPREEQYNSTYRVVSVLTVLHQ
DWLNGKEYKCKVSNKARPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHY
TQKSLSLSPGKGGGGSGGGGSAPTSSSTKKTQLQLEHLLLDLQMILNGINNYKNPKLTRMLTF
KFYMPKKATELKHLQCLEEELKPLEEVLNLAQSKNFHLRPRDLISNINVIVLELKGSETTFMCEY
ADETATIVEFLNRWITFCQSIISTLT

Light chain (OKT4A_L1): (SEQ ID NO: 175)

DIQMTQSPSSLSASVGDRVTITC<u>QASQDINNYIA</u>WYQHKPGKGPKLLIH<u>YTSTLQP</u>GIPSRFSGS
GSGRDYTLTISSLQPEDFATYYC<u>LQYDNLLFT</u>FGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31FF

13046 - empty-Fc(216)_OKT4A_H1L1_IgG1_pI_ISO(-/+RR)_G236R/L328R_(G4S)2_hIL2(2)

Heavy chain 1 (empty-Fc(216)_IgG1_pI_ISO(-)_C220S/G236R/L328R_(G4S)2_hIL2_fusion):

(SEQ ID NO: 176)

EPKSSDKTHTCPPCPAPELLRGPSVFLFPPKPKDTLMISRTPEVTCVVVDVSHEDPEVQFNWY
VDGVEVHNAKTKPREEQYNSTYRVVSVLTVLHQDWLNGKEYKCKVSNKARPAPIEKTISKAKG
QPREPQVYTLPPSQEEMTKNQVSLTCLVKGFYPSDIAVEWESSGQPENNYNTTPPMLDSDGS
FFLYSKLTVDKSRWQEGNVFSCSVMHEALHNHYTQKSLSLSPGKGGGGSGGGGSAPTSSST
KKTQLQLEHLLLDLQMILNGINNYKNPKLTRMLTFKFYMPKKATELKHLQCLEEELKPLEEVLNL
AQSKNFHLRPRDLISNINVIVLELKGSETTFMCEYADETATIVEFLNRWITFCQSIISTLT

Heavy chain 2 (OKT4A_H1_IgG1_pI_ISO(+RR)_G236R/L328R_hIL2): (SEQ ID NO: 177)

EVQLVESGGGLVQPGGSLRLSCAASGFTFSNYAMSWVRQAPGKRLEWVSAISDHSTNTYYPD
SVKGRFTISRDNAKNTLYLQMNSLRAEDTAVYYCARKYGGDYDPFDYWGQGTLVTVSSASTK
GPSVFPLAPSSKSTSGGTAALGCLVKDYFPEPVTVSWNSGALTSGVHTFPAVLQSSGLYSLSS
VVTVPSSSLGTKTYTCNVNHKPSNTKVDKKVERKSCDKTHTCPRCPAPELLRGPSVFLFPPKP
KDTLMISRTPEVTCVVVDVSHEDPEVKFKWYVDGVEVHNAKTKPREEQYNSTYRVVSVLTVLH
QDWLNGKEYKCKVSNKARPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNH
YTQKSLSLSPGKGGGGSGGGGSAPTSSSTKKTQLQLEHLLLDLQMILNGINNYKNPKLTRMLT
FKFYMPKKATELKHLQCLEEELKPLEEVLNLAQSKNFHLRPRDLISNINVIVLELKGSETTFMCEY
ADETATIVEFLNRWITFCQSIISTLT

Light chain (OKT4A_L1): (SEQ ID NO: 178)

DIQMTQSPSSLSASVGDRVTITCQASQDINNYIAWYQHKPGKGPKLLIHYTSTLQPGIPSRFSGS
GSGRDYTLTISSLQPEDFATYYCLQYDNLLFTFGGGTKVEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31GG

13526 - Ibalizumab_H0L0_scFv_Anti-TAC_H1L1_scFv_Fc(216)_IgG1_pI_ISO(-)/pI_ISO(+RR)_C220S_IgG1

Heavy chain 1 (Ibalizumab_H0L0_scFv_Fc(216)_IgG1_pI_ISO(-)):(SEQ ID NO: 179)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSGG
GGSGGGGSGGGGSGGGGSDIVMTQSPDSLAVSLGERVTMNC<u>KSSQSLLYSTNQKNYLA</u>WY
QQKPGQSPKLLIY<u>WASTRES</u>GVPDRFSGSGSGTDFTLTISSVQAEDVAVYYC<u>QQYYSYRT</u>FG
GGTKLEIKEPKSSDKTHTCPPCPAPELLGGPSVFLFPPKPKDTLMISRTPEVTCVVVDVSHEDP
EVQFNWYVDGVEVHNAKTKPREEQYNSTYRVVSVLTVLHQDWLNGKEYKCKVSNKALPAPIE
KTISKAKGQPREPQVYTLPPSQEEMTKNQVSLTCLVKGFYPSDIAVEWESSGQPENNYNTTPP
MLDSDGSFFLYSKLTVDKSRWQEGNVFSCSVMHEALHNHYTQKSLSLSPG

Heavy chain 2 (Anti-TAC_H1L1_scFv_Fc(216)_IgG1_pI_ISO(+RR)): (SEQ ID NO: 180)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSCR<u>ASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKERKSSDKT
HTCPRCPAPELLGGPSVFLFPPKPKDTLMISRTPEVTCVVVDVSHEDPEVKFKWYVDGVEVHN
AKTKPREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK

Figure 31HH

13527 - Ibalizumab_H0L0_scFv_Anti-TAC_H1L1_scFv_Fc(216)_IgG1_pI_ISO(-)/pI_ISO(+RR)_C220S_IgG1_G236R/L328R Heavy chain 1 (Ibalizumab_H0L0_scFv_Fc(216)_IgG1_pI_ISO(-)_G236R/L328R):

(SEQ ID NO: 181)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSGG
GGSGGGGSGGGGSGGGGSDIVMTQSPDSLAVSLGERVTMNC<u>KSSQSLLYSTNQKNYLA</u>WY
QQKPGQSPKLLIY<u>WASTRES</u>GVPDRFSGSGSGTDFTLTISSVQAEDVAVYYC<u>QQYYSYRT</u>FG
GGTKLEIKEPKSSDKTHTCPPCPAPELLRGPSVFLFPPKPKDTLMISRTPEVTCVVVDVSHEDP
EVQFNWYVDGVEVHNAKTKPREEQYNSTYRVVSVLTVLHQDWLNGKEYKCKVSNKARPAPIE
KTISKAKGQPREPQVYTLPPSQEEMTKNQVSLTCLVKGFYPSDIAVEWESSGQPENNYNTTPP
MLDSDGSFFLYSKLTVDKSRWQEGNVFSCSVMHEALHNHYTQKSLSLSPG

Heavy chain 2 (Anti-TAC_H1L1_scFv_Fc(216)_IgG1_pI_ISO(+RR)_G236R/L328R):

(SEQ ID NO: 182)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKERKSSDKT
HTCPRCPAPELLRGPSVFLFPPKPKDTLMISRTPEVTCVVVDVSHEDPEVKFKWYVDGVEVHN
AKTKPREEQYNSTYRVVSVLTVLHQDWLNGKEYKCKVSNKARPAPIEKTISKAKGQPREPQVY
TLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK

Figure 31II

13528 - Ibalizumab_H0L0_Fab-Anti-TAC_H1L1_scFv_Fc(216)_IgG1_pI_ISO(-)-pI_ISO(+RR)_C220S_IgG1

Heavy chain 1 (Ibalizumab_H0_IgG1_pI_ISO(-)):(SEQ ID NO: 183)

QVQLQQSGPEVVKPGASVKMSCKASGYTFT<u>SYVIH</u>WVRQKPGQGLDWIG<u>YINPYNDGTDYDE
KFKG</u>KATLTSDTSTSTAYMELSSLRSEDTAVYYCAR<u>EKDNYATGAWFAY</u>WGQGTLVTVSSAS
TKGPSVFPLAPSSKSTSGGTAALGCLVKDYFPEPVTVSWNSGALTSGVHTFPAVLQSSGLYSL
SSVVTVPSSSLGTQTYTCNVDHKPSNTKVDKKVEPKSCDKTHTCPPCPAPELLGGPSVFLFPP
KPKDTLMISRTPEVTCVVVDVSHEDPEVQFNWYVDGVEVHNAKTKPREEQYNSTYRVVSVLTV
LHQDWLNGKEYKCKVSNKALPAPIEKTISKAKGQPREPQVYTLPPSQEEMTKNQVSLTCLVKG
FYPSDIAVEWESSGQPENNYNTTPPMLDSDGSFFLYSKLTVDKSRWQEGNVFSCSVMHEALH
NHYTQKSLSLSPG

Heavy chain 2 (Anti-TAC_H1L1_scFv_Fc(216)_IgG1_pI_ISO(+RR)): (SEQ ID NO: 184)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKERKSSDKT
HTCPRCPAPELLGGPSVFLFPPKPKDTLMISRTPEVTCVVVDVSHEDPEVKFKWYVDGVEVHN
AKTKPREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK

Light chain (Ibalizumab_L0): (SEQ ID NO: 185)

DIVMTQSPDSLAVSLGERVTMNC<u>KSSQSLLYSTNQKNYLA</u>WYQQKPGQSPKLLIY<u>WASTRES</u>
GVPDRFSGSGSGTDFTLTISSVQAEDVAVYYC<u>QQYYSYRT</u>FGGGTKLEIKRTVAAPSVFIFPPS
DEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Figure 31JJ

13645 - hIL2_0.1_empty-Fc(216)_IgG1_pI_ISO(-/+)_C220S/G236R/L328R

Heavy chain 1 (hIL2_0.1_IgG1_pI_ISO(-)_C220S/G236R/L328R): (SEQ ID NO: 186)

APASSSTKKTQLQLEHLLLDLQMILNGINNYKNPKLTRMLTAKFAMPKKATELKHLQCLEEELKP
LEEVLNGAQSKNFHLRPRDLISNINVIVLELKGSETTFMCEYADETATIVEFLNRWITFAQSIISTL
TGPSVFLFPPKPKDTLMISRTPEVTCVVVDVSHEDPEVQFNWYVDGVEVHNAKTKPREEQYNS
TYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVF
SCSVMHEALHNHYTQKSLSLSPG

Heavy chain 2 (empty-Fc(216)_IgG1_pI_ISO(+)_G236R/L328R): (SEQ ID NO: 187)

EPKSSDKTHTCPPCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Figure 31KK

13646 - hIL2_0.2_empty-Fc(216)_IgG1_pI_ISO(-/+)_C220S/G236R/L328R

Heavy chain 1 (hIL2_0.2_IgG1_pI_ISO(-)_C220S/G236R/L328R): (SEQ ID NO: 188)

APASSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFSQSIISTLT
GPSVFLFPPKPKDTLMISRTPEVTCVVVDVSHEDPEVQFNWYVDGVEVHNAKTKPREEQYNST
YRVVSVLTVLHQDWLNGKEYKCKVSNKARPAPIEKTISKAKGQPREPQVYTLPPSQEEMTKNQ
VSLTCLVKGFYPSDIAVEWESSGQPENNYNTTPPMLDSDGSFFLYSKLTVDKSRWQEGNVFS
CSVMHEALHNHYTQKSLSLSPG

Heavy chain 2 (empty-Fc(216)_IgG1_pI_ISO(+)_G236R/L328R): (SEQ ID NO: 189)

EPKSSDKTHTCPPCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Figure 31LL

13647 - hIL2_0.3_empty-Fc(216)_IgG1_pI_ISO(-/+)_C220S/G236R/L328R

Heavy chain 1 (hIL2_0.3_IgG1_pI_ISO(-)_C220S/G236R/L328R): (SEQ ID NO: 190)

APASSSTKKTQLQLEHLLLDLQMILNGINNYKNPKLTRMLTAKFAMPKKATELKHLQCLEEELKP
LEEVLNGAQSKNFHLRPRDLISNINVIVLELKGSETTFMCEYADETATIVEFLNRWITFAQSIISTL
TGPSVFLFPPKPKDTLMISRTPEVTCVVVDVSHEDPEVQFNWYVDGVEVHNAKTKPREEQYNS
TYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVF
SCSVMHEALHNHYTQKSLSLSPG

Heavy chain 2 (empty-Fc(216)_IgG1_pI_ISO(+)_G236R/L328R): (SEQ ID NO: 191)

EPKSSDKTHTCPPCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Figure 31MM

13648 - hIL2_0.4_empty-Fc(216)_IgG1_pI_ISO(-/+)_C220S/G236R/L328R

Heavy chain 1 (hIL2_0.4_empty-Fc(216)_IgG1_pI_ISO(-/+)_C220S/G236R/L328R:

(SEQ ID NO: 192)

APTSSSTKKTQLQLEHLLLDLQMILNGISNHKNPRLARMLTFKFYMPEKATELKHLQCLEEELKP
LEEALRLAPSKNFHLRPRDLISDVNVIVLELKGSETTFMCEYADETATIVEFLNRWITFSQSIISTL
TGPSVFLFPPKPKDTLMISRTPEVTCVVVDVSHEDPEVQFNWYVDGVEVHNAKTKPREEQYNS
TYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVF
SCSVMHEALHNHYTQKSLSLSPG

Heavy chain 2 (empty-Fc(216)_IgG1_pI_ISO(+)_G236R/L328R): (SEQ ID NO: 193)

EPKSSDKTHTCPPCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Figure 31NN

13649 - hIL2_0.5_empty-Fc(216)_IgG1_pI_ISO(-/+)_C220S/G236R/L328R

Heavy chain 1 (hIL2_0.5_IgG1_pI_ISO(-)_C220S/G236R/L328R): (SEQ ID NO: 194)

APTSSSTKKTQLQLEHLLLDLQMILNGINNYKNPKLTRMLTFKFYMPKKATELKHLQCLEEELKP
LEEALNLAPSKNFHLRPRDLISNINVIVLELKGSETTFMCEYADETATIVEFLNRWITFSQSTISTL
TGPSVFLFPPKPKDTLMISRTPEVTCVVVDVSHEDPEVQFNWYVDGVEVHNAKTKPREEQYNS
TYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVF
SCSVMHEALHNHYTQKSLSLSPG

Heavy chain 2 (empty-Fc(216)_IgG1_pI_ISO(+)_G236R/L328R): (SEQ ID NO: 195)

EPKSSDKTHTCPPCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Figure 31OO

13650 - hIL2_0.6_empty-Fc(216)_IgG1_pI_ISO(-/+)_C220S/G236R/L328R

Heavy chain 1 (hIL2_0.6_IgG1_pI_ISO(-)_C220S/G236R/L328R): (SEQ ID NO: 196)

APTSSSTKKTQLQLEHLLLDLQMILNGISNHKNPRLARMLTFKFYMPEKATELKHLQCLEEELKP
LEEALRLAPSKNFHLRPRDLISDVNVIVLELKGSETTFMCEYADETATIVEFLNRWITFSTSIISTL
TGPSVFLFPPKPKDTLMISRTPEVTCVVVDVSHEDPEVQFNWYVDGVEVHNAKTKPREEQYNS
TYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVF
SCSVMHEALHNHYTQKSLSLSPG

Heavy chain 2 (empty-Fc(216)_IgG1_pI_ISO(+)_G236R/L328R): (SEQ ID NO: 197)

EPKSSDKTHTCPPCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Figure 31PP

13651 - hIL2_0.7_empty-Fc(216)_IgG1_pI_ISO(-/+)_C220S/G236R/L328R

Heavy chain 1 (hIL2_0.7_IgG1_pI_ISO(-)_C220S/G236R/L328R): (SEQ ID NO: 198)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFSTSIISTLT
GPSVFLFPPKPKDTLMISRTPEVTCVVVDVSHEDPEVQFNWYVDGVEVHNAKTKPREEQYNST
YRVVSVLTVLHQDWLNGKEYKCKVSNKARPAPIEKTISKAKGQPREPQVYTLPPSQEEMTKNQ
VSLTCLVKGFYPSDIAVEWESSGQPENNYNTTPPMLDSDGSFFLYSKLTVDKSRWQEGNVFS
CSVMHEALHNHYTQKSLSLSPG

Heavy chain 2 (empty-Fc(216)_IgG1_pI_ISO(+)_G236R/L328R): (SEQ ID NO: 199)

EPKSSDKTHTCPPCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Figure 31QQ

13652 - hIL2_0.8_empty-Fc(216)_IgG1_pI_ISO(-/+)_C220S/G236R/L328R

Heavy chain 1 (hIL2_0.8_IgG1_pI_ISO(-)_C220S/G236R/L328R): (SEQ ID NO: 200)

APTSSSTKKTQLQLEHLLLDLQMILNGINNYKNPKLTRMLTFKFYMPKKATELKHLQCLEEELKP
LEEVLNLAQSKNFHLRPRDLISRINVIVLELKGSETTFMCEYADETATIVEFLNRWITFSQSIISTLT
GPSVFLFPPKPKDTLMISRTPEVTCVVVDVSHEDPEVQFNWYVDGVEVHNAKTKPREEQYNST
YRVVSVLTVLHQDWLNGKEYKCKVSNKARPAPIEKTISKAKGQPREPQVYTLPPSQEEMTKNQ
VSLTCLVKGFYPSDIAVEWESSGQPENNYNTTPPMLDSDGSFFLYSKLTVDKSRWQEGNVFS
CSVMHEALHNHYTQKSLSLSPG

Heavy chain 2 (empty-Fc(216)_IgG1_pI_ISO(+)_G236R/L328R): (SEQ ID NO: 201)

EPKSSDKTHTCPPCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Figure 31RR

13672 - Anti-TAC_H1L1_Fab_empty-Fc(216)_IgG1_pI_ISO(-)_pI_ISO(+RR)_IgG1_C220S/G236R/L328R Heavy chain 1 (Anti-TAC_H1_IgG1_pI_ISO(-)_G236R/L328R): (SEQ ID NO: 202)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSASTKGPSV
FPLAPSSKSTSGGTAALGCLVKDYFPEPVTVSWNSGALTSGVHTFPAVLQSSGLYSLSSVVTV
PSSSLGTQTYTCNVDHKPSNTKVDKKVEPKSCDKTHTCPPCPAPELLRGPSVFLFPPKPKDTL
MISRTPEVTCVVVDVSHEDPEVQFNWYVDGVEVHNAKTKPREEQYNSTYRVVSVLTVLHQDW
LNGKEYKCKVSNKARPAPIEKTISKAKGQPREPQVYTLPPSQEEMTKNQVSLTCLVKGFYPSDI
AVEWESSGQPENNYNTTPPMLDSDGSFFLYSKLTVDKSRWQEGNVFSCSVMHEALHNHYTQ
KSLSLSPG

Heavy chain 2 (empty-Fc(216)_IgG1_pI_ISO(+RR)_C220S/G236R/L328R): (SEQ ID NO: 203)

ERKSSDKTHTCPRCPAPELLRGPSVFLFPPKPKDTLMISRTPEVTCVVVDVSHEDPEVKFKWY
VDGVEVHNAKTKPREEQYNSTYRVVSVLTVLHQDWLNGKEYKCKVSNKARPAPIEKTISKAKG
QPREPQVYTLPPSREEMTKNQVSLTCLVKGFYPSDIAVEWESNGQPENNYKTTPPVLDSDGS
FFLYSKLTVDKSRWQQGNVFSCSVMHEALHNHYTQKSLSLSPGK

Light chain (anti-TAC_L1): (SEQ ID NO: 204)

QIVLTQSPATLSLSPGERATLSC<u>RASSSISYMH</u>WFQQKPGQSPQLLIY<u>TTSNLAS</u>GVPARFSGS
GSGTDYTLTISSLQPEDFAVYYC<u>HQRSTYPLT</u>FGSGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31SS

13801 - 5A8_H1L1_IgG1

Heavy chain (5A8_H1_IgG1): (SEQ ID NO: 205)

QVQLVQSGAEVKKPGASVKVSCKASGYTFT<u>SYVIH</u>WVRQAPGQGLEWMG<u>YINPYNDGTDYD
EKFQG</u>RVTMTSDKSISTAYMELSRLRSDDTAVYYCAR<u>EKDNYATGAWFAY</u>WGQGTLVTVSSA
STKGPSVFPLAPSSKSTSGGTAALGCLVKDYFPEPVTVSWNSGALTSGVHTFPAVLQSSGLYS
LSSVVTVPSSSLGTQTYICNVNHKPSNTKVDKKVEPKSCDKTHTCPPCPAPELLGGPSVFLFPP
KPKDTLMISRTPEVTCVVVDVSHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKG
FYPSDIAVEWESNGQPENNYKTTPPVLDSDGSFFLYSKLTVDKSRWQQGNVFSCSVMHEALH
NHYTQKSLSLSPGK

Light chain (5A8_L1): (SEQ ID NO: 206)

DIVMTQSPDSLAVSLGERATINC<u>KSSQSLLYSTNQKNYLA</u>WYQQKPGQSPKLLIY<u>WASTRES</u>G
VPDRFTGSGSGTDFTLTISSLQAEDVAVYYC<u>QQYYSYRT</u>FGGGTKLEIKRTVAAPSVFIFPPSD
EQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 31TT

13802 - hIL2-Ipilimumab_H0L0_IgG1_PVA_/S267K_IgG1_C220S/S364K/E357Q-pI(-
)_Isosteric_A_L368D/K370S Heavy chain 1 (hIL2_IgG1_C220S/PVA_/S267K/S364K/E357Q): (SEQ ID NO: 207)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (Ipilimumab_H0_IgG1_pI(-)_Isosteric_A_PVA_/S267K/L368D/K370S):

(SEQ ID NO: 208)

QVQLVESGGGVVQPGRSLRLSCAASGFTFS<u>SYTMH</u>WVRQAPGKGLEWVT<u>FISYDGNNKYYA
DSVKG</u>RFTISRDNSKNTLYLQMNSLRAEDTAIYYCAR<u>TGWLGPFDY</u>WGQGTLVTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQ
KSLSLSPGK

Light chain (Ipilimumab_L0) (SEQ ID NO: 209)

EIVLTQSPGTLSLSPGERATLSC<u>RASQSVGSSYLA</u>WYQQKPGQAPRLLIY<u>GAFSRAT</u>GIPDRFS
GSGSGTDFTLTISRLEPEDFAVYYC<u>QQYGSSPWT</u>FGQGTKVEIKRTVAAPSVFIFPPSDEQLKS
GTASVVCLLNNFYPREAKVQWKVDNALQSGNSQESVTEQDSKDSTYSLSSTLTLSKADYEKH
KVYACEVTHQGLSSPVTKSFNRGEC

Figure 31UU

13803 - hIL2-mAb1567_H0L0_IgG1_PVA_/S267K_IgG1_C220S/S364K/E357Q-pI(-)_Isosteric_A_L368D/K370S Heavy chain 1 (hIL2_IgG1_C220S/PVA_/S267K/S364K/E357Q): (SEQ ID NO: 210)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (mAb1567_H0_IgG1_pI(-)_Isosteric_A_PVA_/S267K/L368D/K370S):

(SEQ ID NO: 211)

QVQLQQSGPELVRPGASVRISCKASGYTFA<u>SYYIQ</u>WMKQRPGQGLEWIG<u>WINPGNVNTKYNE
KFKG</u>KATLTADKSSTTAYMQLSSLTSEDSAVYFCAR<u>STYYRPLDY</u>WGQGTTVTVSSASTKGPS
VFPLAPSSKSTSGGTAALGCLVKDYFPEPVTVSWNSGALTSGVHTFPAVLQSSGLYSLSSVVT
VPSSSLGTQTYICNVNHKPSDTKVDKKVEPKSCDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQ
KSLSLSPGK

Light chain (mAb1567_L0): (SEQ ID NO: 212)

DIELTQSPSSLAVSAGEKVTMSC<u>KSSQSILYSSNQKNYLA</u>WYQQKPGQSPKLLIY<u>WASTRESG</u>
VPDRFTGSGSGTDFTLTISSVQAEDLAVYYC<u>HQYLSSYT</u>FGGGTKLEIKRTVAAPSVFIFPPSDE
QLKSGTASVVCLLNNFYPREAKVQWKVDNALQSGNSQESVTEQDSKDSTYSLSSTLTLSKADY
EKHKVYACEVTHQGLSSPVTKSFNRGEC

Figure 31VV

13804 - hIL2-5A8_H1L1_IgG1_PVA_/S267K_IgG1_C220S/S364K/E357Q-pI(-
)_Isosteric_A_L368D/K370S Heavy chain 1 (hIL2_IgG1_C220S/PVA_/S267K/S364K/E357Q): (SEQ ID NO: 213)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (5A8_H1_IgG1_pI(-)_Isosteric_A_PVA_/S267K/L368D/K370S)

(SEQ ID NO: 214)

QVQLVQSGAEVKKPGASVKVSCKASGYTFT<u>SYVIH</u>WVRQAPGQGLEWMG<u>YINPYNDGTDYD
EKFQG</u>RVTMTSDKSISTAYMELSRLRSDDTAVYYCAR<u>EKDNYATGAWFAY</u>WGQGTLVTVSSA
STKGPSVFPLAPSSKSTSGGTAALGCLVKDYFPEPVTVSWNSGALTSGVHTFPAVLQSSGLYS
LSSVVTVPSSSLGTQTYICNVNHKPSDTKVDKKVEPKSCDKTHTCPPCPAPPVAGPSVFLFPPK
PKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHN
HYTQKSLSLSPGK

Light chain (5A8_L1): (SEQ ID NO: 215)

DIVMTQSPDSLAVSLGERATINC<u>KSSQSLLYSTNQKNYLA</u>WYQQKPGQSPKLLIY<u>WASTRES</u>G
VPDRFTGSGSGTDFTLTISSLQAEDVAVYYC<u>QQYYSYRT</u>FGGGTKLEIKRTVAAPSVFIFPPSD
EQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 31WW

13805 - 5A8_H1L1-Anti-TAC_H1L1_scFv(GKPGS)4_IgG1_pI(-
)_Isosteric_A_PVA_/S267K/L368D/K370S-Fc(216)_IgG1_C220S/PVA_/S267K/S364K/E357Q Heavy chain 1 (5A8_H1_IgG1_pI(-)_Isosteric_A_PVA_/S267K/L368D/K370S)

(SEQ ID NO: 216)

QVQLVQSGAEVKKPGASVKVSCKASGYTFT<u>SYVIH</u>WVRQAPGQGLEWMG<u>YINPYNDGTDYD
EKFQG</u>RVTMTSDKSISTAYMELSRLRSDDTAVYYCAR<u>EKDNYATGAWFAY</u>WGQGTLVTVSSA
STKGPSVFPLAPSSKSTSGGTAALGCLVKDYFPEPVTVSWNSGALTSGVHTFPAVLQSSGLYS
LSSVVTVPSSSLGTQTYICNVNHKPSDTKVDKKVEPKSCDKTHTCPPCPAPPVAGPSVFLFPPK
PKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHN
HYTQKSLSLSPGK

Heavy chain 2 (Anti-
TAC_H1L1_scFv(GKPGS)4_Fc(216)_IgG1_C220S/PVA_/S267K/S364K/E357Q):

(SEQ ID NO: 217)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGKPGSGK
PGSGKPGSGKPGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Light chain (5A8_L1): (SEQ ID NO: 218)

DIVMTQSPDSLAVSLGERATINC<u>KSSQSLLYSTNQKNYLA</u>WYQQKPGQSPKLLIY<u>WASTRESG</u>
VPDRFTGSGSGTDFTLTISSLQAEDVAVYYC<u>QQYYSYRT</u>FGGGTKLEIKRTVAAPSVFIFPPSD
EQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 31XX

13806 - 5A8_H1L1-empty-Fc(216)_IgG1_pI(-)_Isosteric_A_PVA_/S267K/L368D/K370S-IgG1_C220S/PVA_/S267K/S364K/E357Q Heavy chain 1 (5A8_H1_IgG1_pI(-)_Isosteric_A_PVA_/S267K/L368D/K370S)

(SEQ ID NO: 219)

QVQLVQSGAEVKKPGASVKVSCKASGYTFT<u>SYVIH</u>WVRQAPGQGLEWMG<u>YINPYNDGTDYD
EKFQG</u>RVTMTSDKSISTAYMELSRLRSDDTAVYYCAR<u>EKDNYATGAWFAY</u>WGQGTLVTVSSA
STKGPSVFPLAPSSKSTSGGTAALGCLVKDYFPEPVTVSWNSGALTSGVHTFPAVLQSSGLYS
LSSVVTVPSSSLGTQTYICNVNHKPSDTKVDKKVEPKSCDKTHTCPPCPAPPVAGPSVFLFPPK
PKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHN
HYTQKSLSLSPGK

Heavy chain 2 (empty-Fc(216)_IgG1_C220S/PVA_/S267K/S364K/E357Q): (SEQ ID NO: 220)

EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Light chain (5A8_L1): (SEQ ID NO: 221)

DIVMTQSPDSLAVSLGERATINC<u>KSSQSLLYSTNQKNYLA</u>WYQQKPGQSPKLLIY<u>WASTRESG</u>
VPDRFTGSGSGTDFTLTISSLQAEDVAVYYC<u>QQYYSYRT</u>FGGGTKLEIKRTVAAPSVFIFPPSD
EQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 31YY

13810 - Nivolumab_H0L0_IgG1

Heavy chain (Nivolumab_H0_IgG1): (SEQ ID NO: 222)

QVQLVESGGGVVQPGRSLRLDCKASGITFS<u>NSGMH</u>WVRQAPGKGLEWVA<u>VIWYDGSKRYYA
DSVKG</u>RFTISRDNSKNTLFLQMNSLRAEDTAVYYCAT<u>NDDY</u>WGQGTLVTVSSASTKGPSVFPL
APSSKSTSGGTAALGCLVKDYFPEPVTVSWNSGALTSGVHTFPAVLQSSGLYSLSSVVTVPSS
SLGTQTYICNVNHKPSNTKVDKKVEPKSCDKTHTCPPCPAPELLGGPSVFLFPPKPKDTLMISR
TPEVTCVVVDVSHEDPEVKFNWYVDGVEVHNAKTKPREEQYNSTYRVVSVLTVLHQDWLNGK
EYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSL
SPGK

Light chain (Nivolumab_L0): (SEQ ID NO: 223)

EIVLTQSPATLSLSPGERATLSC<u>RASQSVSSYLA</u>WYQQKPGQAPRLLIY<u>DASNRAT</u>GIPARFSG
SGSGTDFTLTISSLEPEDFAVYYC<u>QQSSNWPRT</u>FGQGTKVEIKRTVAAPSVFIFPPSDEQLKSG
TASVVCLLNNFYPREAKVQWKVDNALQSGNSQESVTEQDSKDSTYSLSSTLTLSKADYEKHKV
YACEVTHQGLSSPVTKSFNRGEC

Figure 31ZZ

13811 - hIL2-Nivolumab_H0L0_IgG1_PVA_/S267K_IgG1_C220S/S364K/E357Q-pI(-
)_Isosteric_A_L368D/K370S Heavy chain 1 (hIL2_IgG1_C220S/PVA_/S267K/S364K/E357Q): (SEQ ID NO: 224)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (Nivolumab_H0_IgG1_pI(-)_Isosteric_A_PVA_/S267K/L368D/K370S)

(SEQ ID NO: 225)

QVQLVESGGGVVQPGRSLRLDCKASGITFS<u>NSGMH</u>WVRQAPGKGLEWVA<u>VIWYDGSKRYYA
DSVKG</u>RFTISRDNSKNTLFLQMNSLRAEDTAVYYCAT<u>NDDY</u>WGQGTLVTVSSASTKGPSVFPL
APSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRT
PEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLS
PGK

Light chain (Nivolumab_L0): (SEQ ID NO: 226)

EIVLTQSPATLSLSPGERATLSC<u>RASQSVSSYLA</u>WYQQKPGQAPRLLIY<u>DASNRAT</u>GIPARFSG
SGSGTDFTLTISSLEPEDFAVYYC<u>QQSSNWPRT</u>FGQGTKVEIKRTVAAPSVFIFPPSDEQLKSG
TASVVCLLNNFYPREAKVQWKVDNALQSGNSQESVTEQDSKDSTYSLSSTLTLSKADYEKHKV
YACEVTHQGLSSPVTKSFNRGEC

Figure 31AAA

13812 - Nivolumab_H0L0_Fab-Anti-TAC_H1L1_scFv_(GKPGS)4_IgG1_PVA_/S267K_IgG1_pI(-)_Isosteric_A_L368D/K370S_IgG1_C220S/S364K/E357Q Heavy chain 1 (Nivolumab_H0_IgG1_pI(-)_Isosteric_A_PVA_/S267K/L368D/K370S)

(SEQ ID NO: 227)

QVQLVESGGGVVQPGRSLRLDCKASGITFS<u>NSGMH</u>WVRQAPGKGLEWVA<u>VIWYDGSKRYYA
DSVKG</u>RFTISRDNSKNTLFLQMNSLRAEDTAVYYCAT<u>NDDY</u>WGQGTLVTVSSASTKGPSVFPL
APSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRT
PEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLS
PGK

Heavy chain 2 (Anti-TAC_H1L1_scFv(GKPGS)4_Fc(216)_IgG1_C220S/PVA_/S267K/S364K/E357Q):

(SEQ ID NO: 228)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGKPGSGK
PGSGKPGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Light chain (Nivolumab_L0): (SEQ ID NO: 229)

EIVLTQSPATLSLSPGERATLSC<u>RASQSVSSYLA</u>WYQQKPGQAPRLLIY<u>DASNRAT</u>GIPARFSG
SGSGTDFTLTISSLEPEDFAVYYC<u>QQSSNWPRT</u>FGQGTKVEIKRTVAAPSVFIFPPSDEQLKSG
TASVVCLLNNFYPREAKVQWKVDNALQSGNSQESVTEQDSKDSTYSLSSTLTLSKADYEKHKV
YACEVTHQGLSSPVTKSFNRGEC

Figure 31BBB

13813 - Nivolumab_H0L0_Fab-empty-Fc(216)_IgG1_pI(-)_Isosteric_A_PVA_/S267K/L368D/K370S-IgG1_C220S/PVA_/S267K/S364K/E357Q Heavy chain 1 (Nivolumab_H0_IgG1_pI(-)_Isosteric_A_PVA_/S267K/L368D/K370S)

(SEQ ID NO: 230)

QVQLVESGGGVVQPGRSLRLDCKASGITFSNSGMHWVRQAPGKGLEWVAVIWYDGSKRYYA
DSVKGRFTISRDNSKNTLFLQMNSLRAEDTAVYYCATNDDYWGQGTLVTVSSASTKGPSVFPL
APSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRT
PEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLS
PGK

Heavy chain 2 (empty-Fc(216)_IgG1_C220S/PVA_/S267K/S364K/E357Q): (SEQ ID NO: 231)

EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Light chain (Nivolumab_L0): (SEQ ID NO: 232)

EIVLTQSPATLSLSPGERATLSCRASQSVSSYLAWYQQKPGQAPRLLIYDASNRATGIPARFSG
SGSGTDFTLTISSLEPEDFAVYYCQQSSNWPRTFGQGTKVEIKRTVAAPSVFIFPPSDEQLKSG
TASVVCLLNNFYPREAKVQWKVDNALQSGNSQESVTEQDSKDSTYSLSSTLTLSKADYEKHKV
YACEVTHQGLSSPVTKSFNRGEC

Figure 31CCC

13814 - hIL2-Ipilimumab_H0L0_pI(-)_Isosteric_A_ C220S/PVA_/S267K/L368D/K370S-IgG1_pI_ISO(+RR)_C220S/PVA_/S267K/S364K/E357Q Heavy chain 1 (hIL2_pI(-)_Isosteric_A_C220S/PVA/L368D/K370S) (SEQ ID NO: 233)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Heavy chain 2 (Ipilimumab_H0_IgG1_pI_ISO(+RR)_C220S/PVA_/S267K/S364K/E357Q (SEQ ID NO: 234)

QVQLVESGGGVVQPGRSLRLSCAASGFTFS<u>SYTMH</u>WVRQAPGKGLEWVT<u>FISYDGNNKYYA
DSVKG</u>RFTISRDNSKNTLYLQMNSLRAEDTAIYYCAR<u>TGWLGPFDY</u>WGQGTLVTVSSASTKGP
SVFPLAPSSKSTSGGTAALGCLVKDYFPEPVTVSWNSGALTSGVHTFPAVLQSSGLYSLSSVV
TVPSSSLGTKTYTCNVNHKPSNTKVDKKVERKSCDKTHTCPRCPAPPVAGPSVFLFPPKPKDT
LMISRTPEVTCVVVDVKHEDPEVKFKWYVDGVEVHNAKTKPREEQYNSTYRVVSVLTVLHQD
WLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYT
QKSLSLSPGK

Light chain (Ipilimumab_L0) (SEQ ID NO: 235)

EIVLTQSPGTLSLSPGERATLSC<u>RASQSVGSSYLA</u>WYQQKPGQAPRLLIY<u>GAFSRAT</u>GIPDRFS
GSGSGTDFTLTISRLEPEDFAVYYC<u>QQYGSSPWT</u>FGQGTKVEIKRTVAAPSVFIFPPSDEQLKS
GTASVVCLLNNFYPREAKVQWKVDNALQSGNSQESVTEQDSKDSTYSLSSTLTLSKADYEKH
KVYACEVTHQGLSSPVTKSFNRGEC

Figure 31DDD

13815 - hIL2-mAb1567_H0L0_pI(-)_Isosteric_A_ C220S/PVA_/S267K/L368D/K370S-
IgG1_pI_ISO(+RR)_C220S/PVA_/S267K/S364K/E357Q Heavy chain 1 (hIL2_pI(-)_Isosteric_A_C220S/PVA/L368D/K370S) (SEQ ID NO: 236)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Heavy chain 2 (mAb1567_H0_IgG1_pI_ISO(+RR)_C220S/PVA_/S267K/S364K/E357Q)

(SEQ ID NO: 237)

QVQLQQSGPELVRPGASVRISCKASGYTFA<u>SYYIQ</u>WMKQRPGQGLEWIG<u>WINPGNVNTKYNE
KFKG</u>KATLTADKSSTTAYMQLSSLTSEDSAVYFCAR<u>STYYRPLDY</u>WGQGTTVTVSSASTKGPS
VFPLAPSSKSTSGGTAALGCLVKDYFPEPVTVSWNSGALTSGVHTFPAVLQSSGLYSLSSVVT
VPSSSLGTKTYTCNVNHKPSNTKVDKKVERKSCDKTHTCPRCPAPPVAGPSVFLFPPKPKDTL
MISRTPEVTCVVVDVKHEDPEVKFKWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQ
KSLSLSPGK

Light chain (mAb1567_L0) (SEQ ID NO: 238)

DIELTQSPSSLAVSAGEKVTMSC<u>KSSQSILYSSNQKNYLA</u>WYQQKPGQSPKLLIY<u>WASTRESG</u>
VPDRFTGSGSGTDFTLTISSVQAEDLAVYYC<u>HQYLSSYT</u>FGGGTKLEIKRTVAAPSVFIFPPSDE
QLKSGTASVVCLLNNFYPREAKVQWKVDNALQSGNSQESVTEQDSKDSTYSLSSTLTLSKADY
EKHKVYACEVTHQGLSSPVTKSFNRGEC

Figure 31EEE

13816 - hIL2-5A8_H1L1_pI(-)_Isosteric_A_ C220S/PVA_/S267K/L368D/K370S-
IgG1_pI_ISO(+RR)_C220S/PVA_/S267K/S364K/E357Q Heavy chain 1 (hIL2_pI(-)_Isosteric_A_C220S/PVA/L368D/K370S) (SEQ ID NO: 239)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Heavy chain 2 (5A8_H1_IgG1_pI_ISO(+RR)_C220S/PVA_/S267K/S364K/E357Q)

(SEQ ID NO: 240)

QVQLVQSGAEVKKPGASVKVSCKASGYTFT<u>SYVIH</u>WVRQAPGQGLEWMG<u>YINPYNDGTDYD
EKFQG</u>RVTMTSDKSISTAYMELSRLRSDDTAVYYCAR<u>EKDNYATGAWFAY</u>WGQGTLVTVSSA
STKGPSVFPLAPSSKSTSGGTAALGCLVKDYFPEPVTVSWNSGALTSGVHTFPAVLQSSGLYS
LSSVVTVPSSSLGTKTYTCNVNHKPSNTKVDKKVERKSCDKTHTCPRCPAPPVAGPSVFLFPP
KPKDTLMISRTPEVTCVVVDVKHEDPEVKFKWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVMHEALH
NHYTQKSLSLSPGK

Light chain (5A8_L1): (SEQ ID NO: 241)

DIVMTQSPDSLAVSLGERATINC<u>KSSQSLLYSTNQKNYLA</u>WYQQKPGQSPKLLIY<u>WASTRES</u>G
VPDRFTGSGSGTDFTLTISSLQAEDVAVYYC<u>QQYYSYRT</u>FGGGTKLEIKRTVAAPSVFIFPPSD
EQLKSGTASVVCLLNNFYPREAKVQWKVDNALQSGNSQESVTEQDSKDSTYSLSSTLTLSKAD
YEKHKVYACEVTHQGLSSPVTKSFNRGEC

Figure 31FFF

13817 - hIL2-Nivolumab_H0L0_pI(-)_Isosteric_A_C220S/PVA_/S267K/L368D/K370S-IgG1_pI_ISO(+RR)_/PVA_/S267K/S364K/E357Q Heavy chain 1 (hIL2_pI(-)_Isosteric_A_C220S/PVA/L368D/K370S): (SEQ ID NO: 242)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Heavy chain 2 (Nivolumab_H0_IgG1_pI_ISO(+RR)_C220S/PVA_/S267K/S364K/E357Q):

(SEQ ID NO: 243)

QVQLVESGGGVVQPGRSLRLDCKASGITFS<u>NSGMH</u>WVRQAPGKGLEWVA<u>VIWYDGSKRYYA
DSVKG</u>RFTISRDNSKNTLFLQMNSLRAEDTAVYYCAT<u>NDDY</u>WGQGTLVTVSSASTKGPSVFPL
APSSKSTSGGTAALGCLVKDYFPEPVTVSWNSGALTSGVHTFPAVLQSSGLYSLSSVVTVPSS
SLGTKTYTCNVNHKPSNTKVDKKVERKSCDKTHTCPRCPAPPVAGPSVFLFPPKPKDTLMISR
TPEVTCVVVDVKHEDPEVKFKWYVDGVEVHNAKTKPREEQYNSTYRVVSVLTVLHQDWLNGK
EYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSL
SPGK

Light chain (Nivolumab L0): (SEQ ID NO: 244)

EIVLTQSPATLSLSPGERATLSC<u>RASQSVSSYLA</u>WYQQKPGQAPRLLIY<u>DASNRAT</u>GIPARFSG
SGSGTDFTLTISSLEPEDFAVYYC<u>QQSSNWPRT</u>FGQGTKVEIKRTVAAPSVFIFPPSDEQLKSG
TASVVCLLNNFYPREAKVQWKVDNALQSGNSQESVTEQDSKDSTYSLSSTLTLSKADYEKHKV
YACEVTHQGLSSPVTKSFNRGEC

Figure 31GGG

13791 - OKT8_H0.1_L0.1_IgG1

Heavy chain (OKT8_H0.1_IgG1): (SEQ ID NO: 245)

QVKLQESGAELVKPGASVKLSCTASGFNIK<u>DTYIH</u>FVRQRPEQGLEWIG<u>RIDPANDNTLYASKF
QG</u>KATITADTSSNTAYMHLSSLTSGDTAVYYCGR<u>GYGYYVFDH</u>WGQGTTVTVSSASTKGPSV
FPLAPSSKSTSGGTAALGCLVKDYFPEPVTVSWNSGALTSGVHTFPAVLQSSGLYSLSSVVTV
PSSSLGTQTYICNVNHKPSNTKVDKKVEPKSCDKTHTCPPCPAPELLGGPSVFLFPPKPKDTL
MISRTPEVTCVVVDVSHEDPEVKFNWYVDGVEVHNAKTKPREEQYNSTYRVVSVLTVLHQDW
LNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQ
KSLSLSPGK

Light chain (OKT8_L0.1): (SEQ ID NO: 246)

DIKMTQSPSFLAASPGETITINC<u>RTSRSISQYLA</u>WYQEKPGKTNKLLIY<u>SGSTLQS</u>GIPSRFSGS
GSGTDFTLTISGLEPEDFAMYYC<u>QQHNENPLT</u>FGAGTKLEIKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC

Figure 31HHH

13792 - OKT8_H0.1_L1_IgG1

Heavy chain (OKT8_H0.1_IgG1): (SEQ ID NO: 247)

QVKLQESGAELVKPGASVKLSCTASGFNIK<u>DTYIH</u>FVRQRPEQGLEWIG<u>RIDPANDNTLYASKF
QG</u>KATITADTSSNTAYMHLSSLTSGDTAVYYCGR<u>GYGYYVFDH</u>WGQGTTVTVSSASTKGPSV
FPLAPSSKSTSGGTAALGCLVKDYFPEPVTVSWNSGALTSGVHTFPAVLQSSGLYSLSSVVTV
PSSSLGTQTYICNVNHKPSNTKVDKKVEPKSCDKTHTCPPCPAPELLGGPSVFLFPPKPKDTL
MISRTPEVTCVVVDVSHEDPEVKFNWYVDGVEVHNAKTKPREEQYNSTYRVVSVLTVLHQDW
LNGKEYKCKVSNKALPAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCSVMHEALHNHYTQ
KSLSLSPGK

Light chain (OKT8_L1): (SEQ ID NO: 248)

DIKMTQSPSSLSASVGDRVTITC<u>RTSRSISQYLA</u>WYQEKPGKTNKLLIY<u>SGSTLQS</u>GIPSRFSGS
GSGTDFTLTISSLQPEDFATYYC<u>QQHNENPLT</u>FGAGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31III

13793 - OKT8_H1_L0.1_IgG1

Heavy chain (OKT8_H1_IgG1): (SEQ ID NO: 249)

EVQLQQSGAEVKKPGASVKVSCKASGFNIK<u>DTYIH</u>WVRQAPGKGLEWMG<u>RIDPANDNTLYAS
KFQG</u>RVTITADTSTNTAYMELSSLRSEDTAVYYCGR<u>GYGYYVFDH</u>WGQGTTVTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSNTKVDKKVEPKSCDKTHTCPPCPAPELLGGPSVFLFPPKPKDT
LMISRTPEVTCVVVDVSHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYT
QKSLSLSPGK

Light chain (OKT8_L0.1) (SEQ ID NO: 250)

DIKMTQSPSFLAASPGETITINCRTSR<u>SISQYLA</u>WYQEKPGKTNKLLIY<u>SGSTLQS</u>GIPSRFSGS
GSGTDFTLTISGLEPEDFAMYYC<u>QQHNENPLT</u>FGAGTKLEIKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC

Figure 31JJJ

13794 - OKT8_H1_L1_IgG1

Heavy chain (OKT8_H1_IgG1): (SEQ ID NO: 251)

EVQLQQSGAEVKKPGASVKVSCKASGFNIK<u>DTYIH</u>WVRQAPGKGLEWMG<u>RIDPANDNTLYAS
KFQG</u>RVTITADTSTNTAYMELSSLRSEDTAVYYCGR<u>GYGYYVFDH</u>WGQGTTVTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSNTKVDKKVEPKSCDKTHTCPPCPAPELLGGPSVFLFPPKPKDT
LMISRTPEVTCVVVDVSHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYT
QKSLSLSPGK

Light chain (OKT8_L1): (SEQ ID NO: 252)

DIKMTQSPSSLSASVGDRVTITC<u>RTSRSISQYLA</u>WYQEKPGKTNKLLIY<u>SGSTLQS</u>GIPSRFSGS
GSGTDFTLTISSLQPEDFATYYC<u>QQHNENPLT</u>FGAGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31KKK

13807 - hIL2-OKT8_H1L1_IgG1_C220S/PVA_/S267K/S364K/E357Q-IgG1_pI(-)_Isosteric_A_/PVA_/S267K/L368D/K370S Heavy chain 1 (hIL2_IgG1_C220S/PVA_/S267K/S364K/E357Q): (SEQ ID NO: 253)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Heavy chain 2 (OKT8_H1_IgG1_pI(-)_Isosteric_A_/PVA_/S267K/L368D/K370S

(SEQ ID NO: 254)

EVQLQQSGAEVKKPGASVKVSCKASGFNIK<u>DTYIH</u>WVRQAPGKGLEWMG<u>RIDPANDNTLYAS
KFQG</u>RVTITADTSTNTAYMELSSLRSEDTAVYYCGR<u>GYGYYVFDH</u>WGQGTTVTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQ
KSLSLSPGK

Light chain (OKT8_L1) (SEQ ID NO: 255)

DIKMTQSPSSLSASVGDRVTITC<u>RTSRSISQYLA</u>WYQEKPGKTNKLLIY<u>SGSTLQS</u>GIPSRFSGS
GSGTDFTLTISSLQPEDFATYYC<u>QQHNENPLT</u>FGAGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31LLL

13808 - OKT8_H1L1_Fab-Anti-TAC_H1L1_scFv_(GKPGS)4_IgG1_pI(-)_Isosteric_A_/PVA_/S267K/L368D/K370S-IgG1_C220S/PVA_/S267K/S364K/E357Q Heavy chain 1 (OKT8_H1_IgG1_pI(-)_Isosteric_A_/PVA_/S267K/L368D/K370S):

(SEQ ID NO: 256)

EVQLQQSGAEVKKPGASVKVSCKASGFNIK<u>DTYIH</u>WVRQAPGKGLEWMG<u>RIDPANDNTLYAS
KFQG</u>RVTITADTSTNTAYMELSSLRSEDTAVYYCGR<u>GYGYYVFDH</u>WGQGTTVTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQ
KSLSLSPGK

Heavy chain 2 (Anti-TAC_H1L1_scFv_(GKPGS)4_IgG1_C220S/PVA_/S267K/S364K/E357Q):

(SEQ ID NO: 257)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGKPGSGK
PGSGKPGSGKPGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Light chain (OKT8_L1): (SEQ ID NO: 258)

DIKMTQSPSSLSASVGDRVTITC<u>RTSRSISQYLA</u>WYQEKPGKTNKLLIY<u>SGSTLQS</u>GIPSRFSGS
GSGTDFTLTISSLQPEDFATYYC<u>QQHNENPLT</u>FGAGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31MMM

13809 - OKT8_H1L1-empty-Fc(216)_IgG1_pI(-)_Isosteric_A_PVA_/S267K/L368D/K370S-IgG1_C220S/PVA_/S267K/S364K/E357Q Heavy chain 1 (OKT8_H1_IgG1_pI(-)_Isosteric_A_/PVA_/S267K/L368D/K370S):

(SEQ ID NO: 259)

EVQLQQSGAEVKKPGASVKVSCKASGFNIK<u>DTYIH</u>WVRQAPGKGLEWMG<u>RIDPANDNTLYAS
KFQG</u>RVTITADTSTNTAYMELSSLRSEDTAVYYCGR<u>GYGYYVFDH</u>WGQGTTVTVSSASTKGP
SVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQ
KSLSLSPGK

Heavy chain 2 (empty-Fc(216)_IgG1_C220S/PVA_/S267K/S364K/E357Q): (SEQ ID NO: 260)

EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK

Light chain (OKT8_L1): (SEQ ID NO: 261)

DIKMTQSPSSLSASVGDRVTITC<u>RTSRSISQYLA</u>WYQEKPGKTNKLLIY<u>SGSTLQS</u>GIPSRFSGS
GSGTDFTLTISSLQPEDFATYYC<u>QQHNENPLT</u>FGAGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31NNN

13818 - hIL2-OKT8_H1L1_IgG1_pI(-)_Isosteric_A_C220S/PVA_/S267K/L368D/K370S-IgG1_pI_ISO(+RR)_/PVA_/S267K/S364K/E357Q Heavy chain 1 (hIL2_IgG1_pI(-)_Isosteric_A_C220S/PVA_/S267K/L368D/K370S):

(SEQ ID NO: 262)

APTSSSTKKTQLQLEHLLLDLQMILNGINNYKNPKLTRMLTFKFYMPKKATELKHLQCLEEELKP
LEEVLNLAQSKNFHLRPRDLISNINVIVLELKGSETTFMCEYADETATIVEFLNRWITFCQSIISTLT
EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Heavy chain 2 (OKT8_H1_IgG1_pI_ISO(+RR)_/PVA_/S267K/S364K/E357Q):

(SEQ ID NO: 263)

EVQLQQSGAEVKKPGASVKVSCKASGFNIK<u>DTYIH</u>WVRQAPGKGLEWMG<u>RIDPANDNTLYAS
KFQG</u>RVTITADTSTNTAYMELSSLRSEDTAVYYCGR<u>GYGYYVFDH</u>WGQGTTVTVSSASTKGP
SVFPLAPSSKSTSGGTAALGCLVKDYFPEPVTVSWNSGALTSGVHTFPAVLQSSGLYSLSSVV
TVPSSSLGTKTYTCNVNHKPSNTKVDKKVERKSCDKTHTCPRCPAPPVAGPSVFLFPPKPKDT
LMISRTPEVTCVVVDVKHEDPEVKFKWYVDGVEVHNAKTKPREEQYNSTYRVVSVLTVLHQD
WLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYT
QKSLSLSPGK

Light chain (OKT8_L1): (SEQ ID NO: 264)

DIKMTQSPSSLSASVGDRVTITC<u>RTSRSISQYLA</u>WYQEKPGKTNKLLIY<u>SGSTLQS</u>GIPSRFSGS
GSGTDFTLTISSLQPEDFATYYC<u>QQHNENPLT</u>FGAGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 31OOO

13819 - OKT8_H1L1_Fab-Anti-TAC_H1L1_scFv_(GGGGS)4_IgG1_pI_ISO(+RR)_/PVA_/S267K/S364K/E357Q-IgG1_pI(-)_Isosteric_A_PVA_/S267K/L368D/K370S Heavy chain 1 (OKT8_H1_IgG1_pI_ISO(+RR)_/PVA_/S267K/S364K/E357Q):

(SEQ ID NO: 265)

EVQLQQSGAEVKKPGASVKVSCKASGFNIK<u>DTYIH</u>WVRQAPGKGLEWMG<u>RIDPANDNTLYAS
KFQG</u>RVTITADTSTNTAYMELSSLRSEDTAVYYCGR<u>GYGYYVFDH</u>WGQGTTVTVSSASTKGP
SVFPLAPSSKSTSGGTAALGCLVKDYFPEPVTVSWNSGALTSGVHTFPAVLQSSGLYSLSSVV
TVPSSSLGTKTYTCNVNHKPSNTKVDKKVERKSCDKTHTCPRCPAPPVAGPSVFLFPPKPKDT
LMISRTPEVTCVVVDVKHEDPEVKFKWYVDGVEVHNAKTKPREEQYNSTYRVVSVLTVLHQD
WLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYT
QKSLSLSPGK

Heavy chain 2 (Anti-TAC_H1L1_scFv_(GGGGS)4_IgG1_pI(-)_Isosteric_A_PVA_/S267K/L368D/K370S: (SEQ ID NO: 266)

QVQLVQSGAEVKKPGASVKVSCKASGYTFT<u>SYRMH</u>WVRQAPGQGLEWMG<u>YINPSTGYTEYN
QKFQG</u>RVTITADKSISTAYMELSRLRSDDTAVYYCAR<u>GGGVFDY</u>WGQGTLVTVSSGGGGSGG
GGSGGGGSGGGGSQIVLTQSPATLSLSPGERATLSC<u>RASSSISYMH</u>WFQQKPGQSPQLLIY<u>TT
SNLAS</u>GVPARFSGSGSGTDYTLTISSLQPEDFAVYYC<u>HQRSTYPLT</u>FGSGTKLEIKEPKSSDKT
HTCPPCPAPPVAGPSVFLFPPKPKDTLMISRTPEVTCVVVDVKHEDPEVKFNWYVDGVEVHNA
KTKPREEEYNSTYRVVSVLTVLHQDWLNGKEYKCKVSNKALPAPIEKTISKAKGQPREPQVYTL
PPSREEMTKNQVSLTCDVSGFYPSDIAVEWESDGQPENNYKTTPPVLDSDGSFFLYSKLTVDK
SRWEQGDVFSCSVMHEALHNHYTQKSLSLSPGK

Light chain (OKT8_L1): (SEQ ID NO: 267)

DIKMTQSPSSLSASVGDRVTITC<u>RTSRSISQYLA</u>WYQEKPGKTNKLLIY<u>SGSTLQS</u>GIPSRFSGS
GSGTDFTLTISSLQPEDFATYYC<u>QQHNENPLT</u>FGAGTKLEIKRTVAAPSVFIFPPSDEQLKSGTA
SVVCLLNNFYPREAKVQWKVDNALQSGNSQESVTEQDSKDSTYSLSSTLTLSKADYEKHKVYA
CEVTHQGLSSPVTKSFNRGEC

Figure 32

| |
|---|
| CD4 (T-cell surface glycoprotein CD4) |
| CD25 (IL-2 receptor α-chain; IL-2Ra) |
| CTLA4 (Cytotoxic T-lymphocyte protein 4; CD152) |
| PD-1 (Programmed cell death protein 1; CD279) |
| CCR4 (C-C chemokine receptor type 4; CD194) |
| GITR (TNFRSF18; Tumor necrosis factor receptor superfamily member 18) |
| LAG-3 (Lymphocyte activation gene 3 protein; CD223) |
| CD62L (L-selectin, LECAM1) |
| CD39 (ENTPD1; Ecto-nucleoside triphosphate diphosphohydrolase 1) |
| CD44 |
| MHCII/HLA-DR |
| LAP |
| CD103 (HML-1; integrin α-E) |
| CCR5 (CD195; C-C chemokine receptor type 5) |
| CCR6 (CD196; C-C chemokine receptor type 6) |
| GARP (LRRC32; Leucine-rich repeat-containing protein 32) |
| Galectin-1 (LGALS1) |
| Galectin-10 |
| Helios (Zinc finger protein Helios) |
| TNFRSF25 (Tumor necrosis factor receptor superfamily member 25; DR3; Death receptor 3) |
| Neuropilin-1 (Nrp1; CD304; Vascular endothelial cell growth factor 165 receptor; VEGF165R) |
| GPR83 (G-protein coupled receptor 83) |
| CD26 (Dipeptidyl peptidase 4; DPP IV ectoenzyme) |
| CD45RA |
| CD45RO |
| CD49d (VLA-4α; Integrin α4) |
| CD101 (Immunoglobulin superfamily member 2; IGSF2; V7) |
| Folate receptor 4 (FR4) |
| CD31 (PECAM-1; platelet endothelial cell adhesion molecule) |
| CD137 (Tumor necrosis factor receptor superfamily member 9; TNFRSF9) |
| OX40 (CD134; Tumor necrosis factor receptor superfamily member 4; TNFRSF4) |

FIG 33A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |

FIG 33B

| Monomer 1 | Monomer 2 |
|---|---|
| T411E/N390D | D401K |
| T411E | D401K/Q347K |
| T411E | D401K/Q347R |
| T411E/K360D/Q362E | D401K |
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |

FIG 33C

| Monomer 1 | Monomer 2 |
|---|---|
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

FIG 34A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |

FIG 34B

| Monomer 1 | Monomer 2 |
|---|---|
| T411E/N390D | D401K |
| T411E | D401K/Q347K |
| T411E | D401K/Q347R |
| T411E/K360D/Q362E | D401K |
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |

FIG 34C

| Monomer 1 | Monomer 2 |
|---|---|
| T411E/Q362E | D401R/T411R |
| T411E/N390D | D401R/T411R |
| I199T/N203D/K247Q/R355Q/N384S/K392N/V397M/Q419E/K447 | Q196K/I199T/P217R/P228R/N276K |
| I199T/N203D/K247Q/R355Q/N384S/K392N/V397M/Q419E/K447 | Q196K/I199T/N276K |
| N384S/K392N/V397M/Q419E | N276K |
| I199T/N203D/K247Q/R355Q/Q419E/K447 | Q196K/I199T/P217R/P228R/N276K |
| I199T/N203D/K247Q/R355Q/Q419E/K447 | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

Figure 35

| Monomer 1 | Monomer 2 |
|---|---|
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |
| K392D/K409D | E356K/D399K |
| K370D/K392D/K409D | E356K/E357K/D399K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |

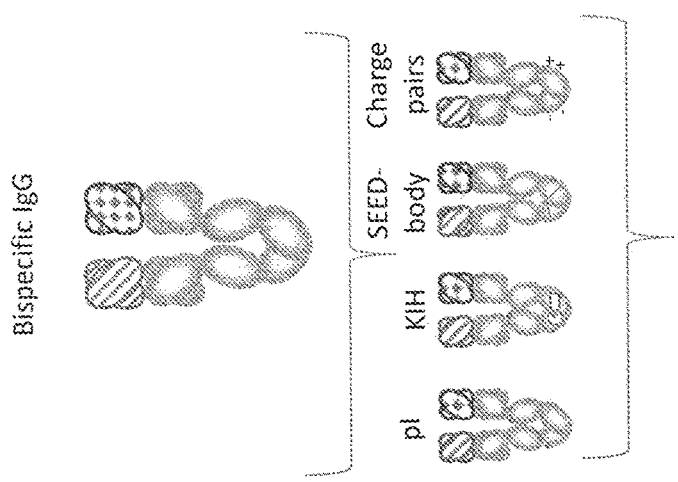

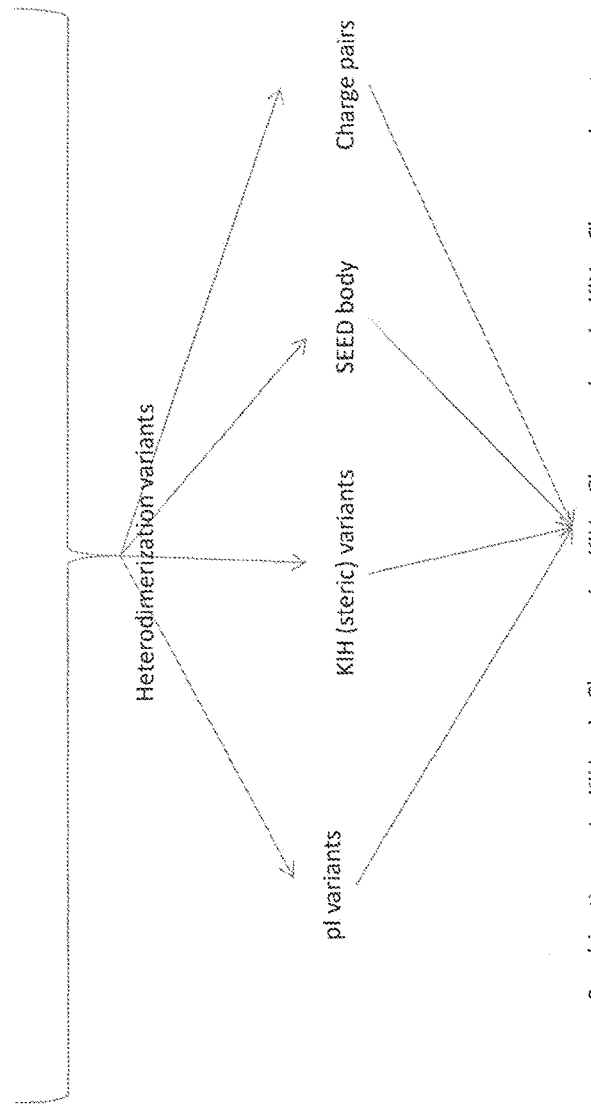

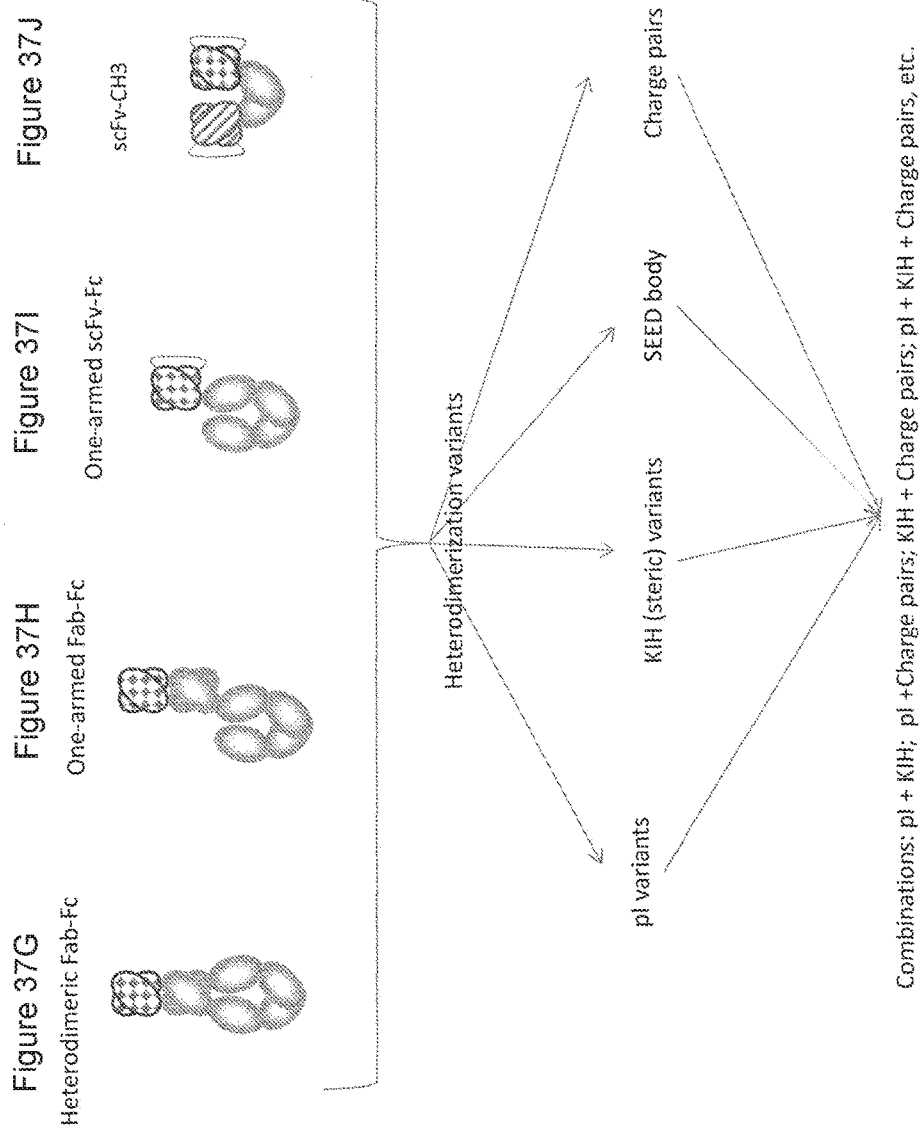

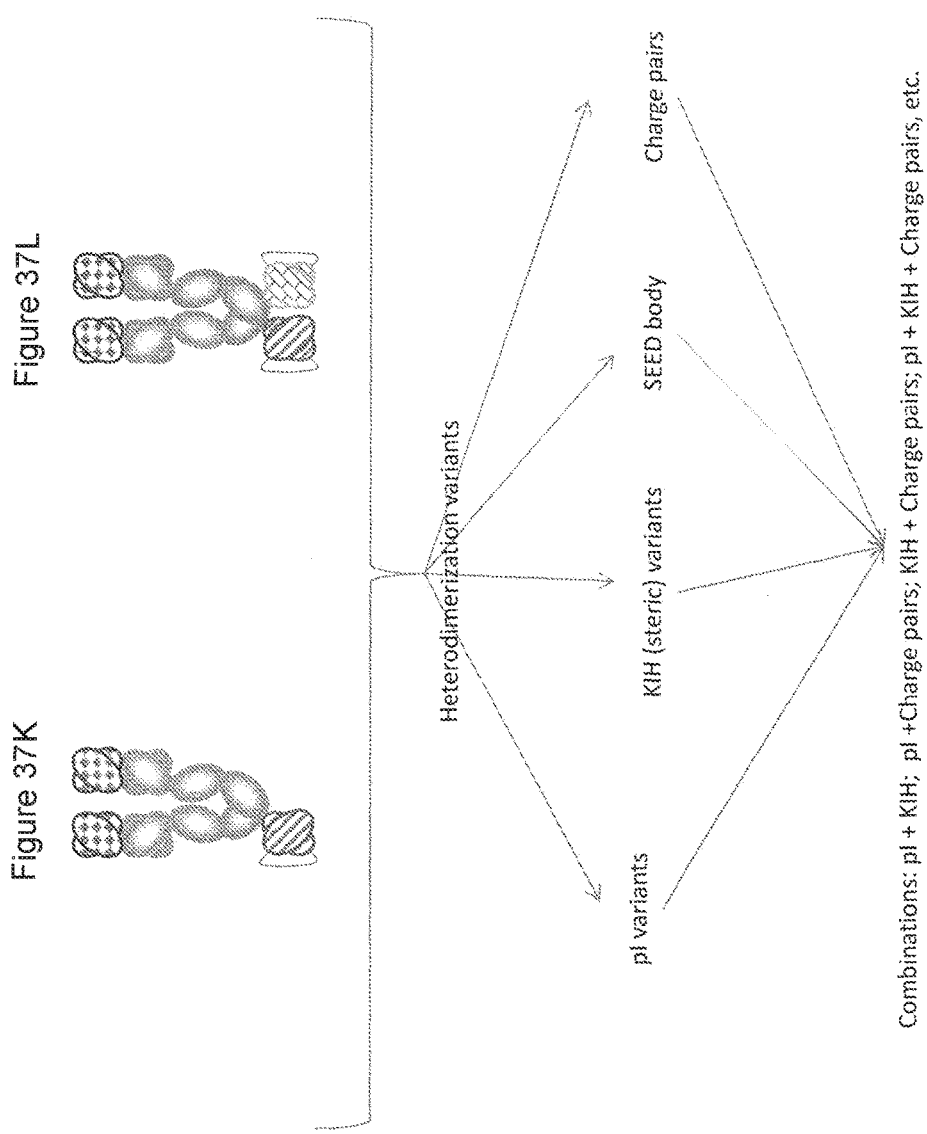

Figures 37N - 37R
Figure 37N
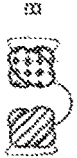
Figure 37O
Figure 37P
Figure 37Q
Figure 37R Figures 37S - 37U
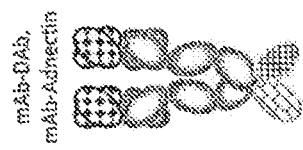
Figure 37S
Figure 37T
Figure 37U

Figure 38

| Variant constant region | Substitutions |
|---|---|
| pI_ISO(-) | I199T N203D K274Q R355Q N384S K392N V397M Q419E DEL447 |
| pI_(-)_isosteric_A | N208D Q295E N384D Q418E N421D |
| pI_(-)_isosteric_B | N208D Q295E Q418E N421D |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_isosteric_E272Q/E283Q | E272Q E283Q |
| pI_(+)_isosteric_E269Q | E269Q |

Figure 39

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | |
| A327Q | |
| L328E | |
| L328R | |
| P329A | |
| P329H | |

Figure 40

Positive charged scFv linkers

| Name | Sequence | Length | Charge | SEQ ID NO: |
|---|---|---|---|---|
| Gly-Ser 15 | GGGGSGGGGSGGGGS | 15 | 0 | 268 |
| Whitlow linker | GSTSGSGKPGSGEGSTKG | 18 | +1 | 269 |
| 6paxA_1 (+A) | IRPRAIGGSKPRVA | 14 | +4 | 270 |
| +B | GKGGSGKGGSGKGGS | 15 | +3 | 271 |
| +C | GGKGSGGKGSGGKGS | 15 | +3 | 272 |
| +D | GGGKSGGGKSGGGKS | 15 | +3 | 273 |
| +E | GKGKSGKGKSGKGKS | 15 | +6 | 274 |
| +F | GGGKSGGKGSGKGGS | 15 | +3 | 275 |
| +G | GKPGSGKPGSGKPGS | 15 | +3 | 276 |
| +H | GKPGSGKPGSGKPGSGKPGS | 20 | +4 | 277 |
| +I | GKGKSGKGKSGKGKSGKGKS | 20 | +8 | 278 |

Negative charged scFv linkers

| Name | Sequence | Length | Charge | |
|---|---|---|---|---|
| Gly-Ser 15 | GGGGSGGGGSGGGGSGGGGS | 20 | 0 | 279 |
| 3hsc_2 (-A) | STAGDTHLGGEDFD | 14 | -4 | 280 |
| -B | GEGGSGEGGSGEGGS | 15 | -3 | 281 |
| -C | GGEGSGGEGSGGEGS | 15 | -3 | 282 |
| -D | GGGESGGGESGGGES | 15 | -3 | 283 |
| -E | GEGESGEGESGEGES | 15 | -6 | 284 |
| -F | GGGESGGEGSGEGGS | 15 | -3 | 285 |
| -G | GEGESGEGESGEGESGEGES | 20 | -8 | 286 |

Figure 41A

HETERODIMERIZATION VARIANTS

| | IgG1 | IgG2 | IgG3 | IgG4 | Variants |
|---|---|---|---|---|---|
| 196 | Q | Q | Q | K | K |
| 199 | I | T | T | T | T |
| 203 | N | D | N | D | D |
| 217 | P | R | L | S | R |
| 220 | C | C | P | G | E,R (IgG2) |
| 221 | D | | LGD | | E,R (IgG1) |
| 222 | K | V | T | – | E,R (IgG2) |
| 223 | T | – | T | – | D,E,R,K |
| 225 | T | – | T | P | D,E,R,K |
| 228 | P | P | RCPEPK SCDTPP PCPRCP EPKSCD TPPPCP RCPEPK SCDTPP PCPR | S | D,E,R,K |
| 247 | P | P | P | P | Q |
| 276 | N | N | K | N | K |
| 340 | K | K | K | K | E,Q |
| 345 | E | E | E | E | K |
| | Q | Q | Q | Q | E,K,R |
| 349 | Y | Y | Y | Y | A,C,D,E,I,K,S,T,W |
| 350 | T | T | T | T | I |
| 351 | L | L | L | L | E,K,V,Y |
| 354 | S | S | S | S | C |
| 355 | R | R | R | Q | E,Q |
| 356 | D | E | E | E | K, L, R |
| 357 | E | E | E | E | K,R,Q,T |
| | K | K | K | K | D,E |
| 362 | Q | Q | Q | Q | E,K |
| | S | S | S | S | C,D,E,F,G,H,K,R,T,Y |
| 366 | T | T | T | T | A,D,I,K,L,M,S,V,W,Y |
| | L | L | L | L | A,D,E,K,S all but C,P |
| 370 | K | K | K | K | C,D,E,G,R,S,T,V all but C,P |
| 371 | G | G | G | G | D |
| 384 | N | N | S | N | S |
| 390 | N | N | N | N | D,E,K,R |
| 392 | K | K | N | K | C,D,E,F,L,M,N |
| 394 | T | T | T | T | F,S,V,W,Y |

Figure 41B

|     | IgG1 | IgG2 | IgG3 | IgG4 | Variants |
|-----|------|------|------|------|----------|
| 395 | P | P | P | P | T,V |
| 396 | P | P | P | P | T,V |
| 397 | V | M | M | V | M,S,T |
| 399 | D | D | D | D | all but C,P<br>C,K,R |
| 400 | S | S | S | S | A,D,E,K,R |
| 401 | D | D | D | D | K,N,R |
| 405 | F | F | F | F | L, all but C,P<br>A,F,L,M,S,T,V |
| 407 | Y | Y | Y | Y | T,V<br>all but C,P<br>A,L,M,V |
| 409 | K | K | K | R | R<br>,all but C,P<br>D,E,F,K,L,M,V,W |
|     | T | T | T | T | D,E,K,L,N,R,S |
| 419 | Q | Q | Q | E | E |
| 439 | K | K | K | K | D,E |

Figure 42A

Preferred steric variants that favor Fc heterodimerization.

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 42B

Specifically preferred steric variants that favor Fc heterodimerization.

| Variant 1 | Variant 2 |
|---|---|
| F405A | T394F |
| S364D | Y349K |
| S364E | Y349K |
| S364H | Y349T |
| L351K | L351E |
| D401K | T411E |
| S364D/T394F | Y349K/F405A |
| S364E/F405A | Y349K/T394F |
| S364H/D401K | Y349T/T411E |
| S364H/F405A | Y349T/T394F |
| S364H/T394F | Y349T/F405A |
| L351K/S364H/D401K | Y349T/L351E/T411E |
| S364H/D401K/F405A | Y349T/T394F/T411E |
| S364H/F405A/T411E | Y349T/T394F/D401K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 42C

Preferred steric variants that favor Fc heterodimerization.

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 42D

| Monomer 1 | Monomer 2 |
|---|---|
| L368D/K370S | S364K |
| L368D/K370S | S364K/E357L |
| L368D/K370S | S364K/E357Q |
| T411E/K360E/Q362E | D401K |
| L368E/K370S | S364K |
| K370S | S364K |
| L368E/K370S | S364K/E357Q |
| K370S | S364K/E357Q |
| L368E/K370S | S364K |
| K370S | S364K |
| L368E/K370S | S364K/E357Q |
| K370S | S364K/E357Q |

Figure 42E

| Monomer 1 | Monomer 2 |
|---|---|
| ISO(-) side | ISO(+) or ISO(++RR)) side |
| T411E | D401K |
| T411E K360D | D401K |
| T411E K360E | D401K |
| T411E Q362E | D401K |
| T411E N390D | D401K |
| T411E | D401K Q347K |
| T411E | D401K Q347R |
| T411E K360D Q362E | D401K |
| T411E K360E Q362E | D401K |
| T411E K360E N390D | D401K |
| T411E Q362E N390D | D401K |
| T411E Q347R | D401K K360D |
| T411E Q347R | D401K K360E |
| T411E K360 | D401K Q347K |
| T411E K360D | D401K Q347R |
| T411E K360E | D401K Q347K |
| T411E K360E | D401K Q347R |
| T411E S364K | D401K K370S |
| T411E K370S | D401K S364K |
| Q347E | E357Q |
| Q347E | E357Q Q362K |
| K360D Q362E | Q347R |
| K360D Q362E | D401K |
| K360D Q362E | Q347R D401K |
| K360E Q362E | Q347R |
| K360E Q362E | D401K |
| K360E Q362E | Q347R D401K |
| Q362E N390D | D401K |
| Q347E K360D | D401N |
| K360D | Q347R N390K |
| K360D | N390KD401N |
| K360E | Y349H |
| K370S Q347E | S364K |
| K370S E357L | S364K |
| K370S E357Q | S364K |
| K370S Q347E E357L | S364K |
| K370S Q347E E357Q | S364K |
| L368D K370S Q347E | S364K |
| L368D K370S E357L | S364K |
| L368D K370S E357Q | S364K |
| L368D K370S Q347E E357L | S364K |
| L368D K370S Q347E E357Q | S364K |
| L368E K370S Q347E | S364K |
| L368E K370S E357L | S364K |
| L368E K370S E357Q | S364K |
| L368E K370S Q347E E357L | S364K |
| L368E K370S Q347E E357Q | S364K |
| L368D K370T Q347E | S364K |
| L368D K370T E357L | S364K |
| L368D K370T E357Q | S364K |

Figure 42F

| Monomer 1 | Monomer 2 |
|---|---|
| L368D K370T Q347E E357L | S364K |
| L368D K370T Q347E E357Q | S364K |
| L368E K370T Q347E | S364K |
| L368E K370T E357L | S364K |
| L368E K370T E357Q | S364K |
| L368E K370T Q347E E357L | S364K |
| L368E K370T Q347E E357Q | S364K |
| T411E Q362E | D401K T411K |
| T411E N390D | D401K T411K |
| T411E Q362E | D401R T411R |
| T411E N390D | D401R T411R |

Figure 42G

| XENP | Heterodimer-skewing variant, Chain 1 | Heterodimer-skewing variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

Figure 42H

PREFERRED HETERODIMERIZATION VARIANTS

| Fc monomer 1 substitutions | Fc monomer 2 substitutions |
|---|---|
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |
| K392D/K409D | E356K/D399K |
| K370D/K392D/K409D | E356K/E357K/D399K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| I199T/N203D/K247Q/R355Q/N384S/K392N/V397M/Q419E/K447_ (deletion of K447) | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |

Figure 42I

| | |
|---|---|
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 42J

| Fc monomer 1 substitutions | Fc monomer 2 substitutions |
|---|---|
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N203D/K247Q/R355Q/N384S/K392N/V397M/Q419E/K447_ | Q196K/P217R/P228R/N276K |
| N203D/K247Q/R355Q/N384S/K392N/V397M/Q419E/K447_ | Q196K/N276K |
| N203D/K247Q/R355Q/N384S/K392N/Q419E/K447_ | Q196K/P217R/P228R/N276K |
| N203D/K247Q/R355Q/N384S/K392N/Q419E/K447_ | Q196K/N276K |

Figure 43

Kappa constant light chain (CK) (SEQ ID NO: 1)
RTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC IgG1 constant heavy chain (CH1-hinge-CH2-CH3) (SEQ ID NO: 2)
ASTKGPSVFPLAPSSKSTSGGTAALGCLVKDYFPEPVTVSWNSGALTSGVHTFPAVLQS
SGLYSLSSVVTVPSSSLGTQTYICNVNHKPSNTKVDKKVEPKSCDKTHTCPPCPAPELLG
GPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDK
SRWQQGNVFSCSVMHEALHNHYTQKSLSLSPGK IgG2 constant heavy chain (CH1-hinge-CH2-CH3) (SEQ ID NO: 3)
ASTKGPSVFPLAPCSRSTSESTAALGCLVKDYFPEPVTVSWNSGALTSGVHTFPAVLQS
SGLYSLSSVVTVPSSNFGTQTYTCNVDHKPSNTKVDKTVERKCCVECPPCPAPPVAGPS
VFLFPPKPKDTLMISRTPEVTCVVVDVSHEDPEVQFNWYVDGVEVHNAKTKPREEQFNS
TFRVVSVLTVVHQDWLNGKEYKCKVSNKGLPAPIEKTISKTKGQPREPQVYTLPPSREE
MTKNQVSLTCLVKGFYPSDIAVEWESNGQPENNYKTTPPMLDSDGSFFLYSKLTVDKSR
WQQGNVFSCSVMHEALHNHYTQKSLSLSPGK IgG3 constant heavy chain (CH1-hinge-CH2-CH3) (SEQ ID NO: 4)
ASTKGPSVFPLAPCSRSTSGGTAALGCLVKDYFPEPVTVSWNSGALTSGVHTFPAVLQS
SGLYSLSSVVTVPSSSLGTQTYTCNVNHKPSNTKVDKRVELKTPLGDTTHTCPRCPEPK
SCDTPPPCPRCPEPKSCDTPPPCPRCPEPKSCDTPPPCPRCPAPELLGGPSVFLFPPKP
KDTLMISRTPEVTCVVVDVSHEDPEVQFKWYVDGVEVHNAKTKPREEQYNSTFRVVSVL
TVLHQDWLNGKEYKCKVSNKALPAPIEKTISKTKGQPREPQVYTLPPSREEMTKNQVSL
TCLVKGFYPSDIAVEWESSGQPENNYNTTPPMLDSDGSFFLYSKLTVDKSRWQQGNIFS
CSVMHEALHNRFTQKSLSLSPGK IgG4 constant heavy chain (CH1-hinge-CH2-CH3) (SEQ ID NO: 5)
ASTKGPSVFPLAPCSRSTSESTAALGCLVKDYFPEPVTVSWNSGALTSGVHTFPAVLQS
SGLYSLSSVVTVPSSSLGTKTYTCNVDHKPSNTKVDKRVESKYGPPCPSCPAPEFLGGP
SVFLFPPKPKDTLMISRTPEVTCVVVDVSQEDPEVQFNWYVDGVEVHNAKTKPREEQFN
STYRVVSVLTVLHQDWLNGKEYKCKVSNKGLPSSIEKTISKAKGQPREPQVYTLPPSQE
EMTKNQVSLTCLVKGFYPSDIAVEWESNGQPENNYKTTPPVLDSDGSFFLYSRLTVDKS
RWQEGNVFSCSVMHEALHNHYTQKSLSLSLGK IgG1/2 constant heavy chain (CH1-hinge-CH2-CH3) (SEQ ID NO: 6)
ASTKGPSVFPLAPSSKSTSGGTAALGCLVKDYFPEPVTVSWNSGALTSGVHTFPAVLQS
SGLYSLSSVVTVPSSSLGTQTYICNVNHKPSNTKVDKKVEPKSCDKTHTCPPCPAPPVA
GPSVFLFPPKPKDTLMISRTPEVTCVVVDVSHEDPEVQFNWYVDGVEVHNAKTKPREEQ
FNSTFRVVSVLTVVHQDWLNGKEYKCKVSNKGLPAPIEKTISKTKGQPREPQVYTLPPSR
EEMTKNQVSLTCLVKGFYPSDIAVEWESNGQPENNYKTTPPMLDSDGSFFLYSKLTVDK
SRWQQGNVFSCSVMHEALHNHYTQKSLSLSPGK

| scFv monomer (+) | Fab monomer (-) |
|---|---|
| Heterodimer pI variants S364K/E357Q | Heterodimerization pI variants L368D/K370S |
| scFv charged linker (GKPGS)4 | Isosteric pI substitutions N208D/Q295E/N384D/Q418E/N421D |
| FcKO E233P/L234V/L235A/G236del/S267K | FcKO E233P/L234V/L235A/G236del/S267K |
| ± 428L/434S for FcRn | ± 428L/434S for FcRn |
| CD25 scFv (+charged linker) | Fv sequences for target antigens, including CD4 |

B

| scFv monomer | Fab monomer |
|---|---|
| Heterodimer pI variants S364K/E357Q | Heterodimerization pI variants L368D/K370S |
| scFv charged linker (GKPGS)4 | pI substitutions I199T N203D K274Q R355Q Q419E K447del |
| FcKO E233P/L234V/L235A/G236del/S267K | FcKO E233P/L234V/L235A/G236del/S267K |
| ± 428L/434S for FcRn (optional) | ± 428L/434S for FcRn (optional) |
| CD25 scFv (+charged linker) | Fv sequences for target antigens, including CD4 |

Figure 45

| AMINO ACID | pI |
|---|---|
| Alanine Ala A | 6.00 |
| Arginine Arg R | 11.15 |
| Asparagine Asn N | 5.41 |
| Aspartic acid Asp D | 2.77 |
| Cysteine Cys C | 5.02 |
| Glutamic acid Glu E | 3.22 |
| Glutamine Gln Q | 5.65 |
| Glycine Gly G | 5.97 |
| Histidine His H | 7.47 |
| Isoleucine Ile I | 5.94 |
| Leucine Leu L | 5.98 |
| Lysine Lys K | 9.59 |
| Methionine Met M | 5.74 |
| Phenylalanine Phe F | 5.48 |
| Proline Pro P | 6.30 |
| Serine Ser S | 5.68 |
| Threonine Thr T | 5.64 |
| Tryptophan Trp W | 5.89 |
| Tyrosine Tyr Y | 5.66 |
| Valine Val V | 5.96 |

Figure 46A

| Variant | # of sub(s) | pI / pI | pI / WT | WT/ WT | avg delta pI |
|---|---|---|---|---|---|
| G137E/N203D/K274Q/R355Q/K392N/Q419E/K447_ | 7 | 6.43 | 7.14 | 8.02 | -0.79 |
| G137E/N203D/K274Q/R355Q/K392N/Q419E | 6 | 6.58 | 7.30 | 8.02 | -0.72 |
| G137E/N203D/K274Q/R355Q/K392N/K447_ | 6 | 6.58 | 7.30 | 8.02 | -0.72 |
| G137E/N203D/K274Q/R355Q/Q419E/K447_ | 6 | 6.58 | 7.30 | 8.02 | -0.72 |
| G137E/N203D/K274Q/K392N/Q419E/K447_ | 6 | 6.58 | 7.30 | 8.02 | -0.72 |
| G137E/N203D/R355Q/K392N/Q419E/K447_ | 6 | 6.58 | 7.30 | 8.02 | -0.72 |
| G137E/K274Q/R355Q/K392N/Q419E/K447_ | 6 | 6.58 | 7.30 | 8.02 | -0.72 |
| N203D/K274Q/R355Q/K392N/Q419E/K447_ | 6 | 6.58 | 7.30 | 8.02 | -0.72 |
| G137E/N203D/K274Q/R355Q/K392N | 5 | 6.76 | 7.46 | 8.02 | -0.63 |
| G137E/N203D/K274Q/R355Q/Q419E | 5 | 6.76 | 7.46 | 8.02 | -0.63 |
| G137E/N203D/K274Q/R355Q/K447_ | 5 | 6.76 | 7.46 | 8.02 | -0.63 |
| G137E/N203D/K274Q/K392N/Q419E | 5 | 6.76 | 7.46 | 8.02 | -0.63 |
| G137E/N203D/K274Q/K392N/K447_ | 5 | 6.76 | 7.46 | 8.02 | -0.63 |
| G137E/N203D/K274Q/Q419E/K447_ | 5 | 6.76 | 7.46 | 8.02 | -0.63 |
| G137E/N203D/R355Q/K392N/Q419E | 5 | 6.76 | 7.46 | 8.02 | -0.63 |
| G137E/N203D/R355Q/K392N/K447_ | 5 | 6.76 | 7.46 | 8.02 | -0.63 |
| G137E/N203D/R355Q/Q419E/K447_ | 5 | 6.76 | 7.46 | 8.02 | -0.63 |
| G137E/N203D/K392N/Q419E/K447_ | 5 | 6.76 | 7.46 | 8.02 | -0.63 |
| G137E/K274Q/R355Q/K392N/Q419E | 5 | 6.76 | 7.46 | 8.02 | -0.63 |
| G137E/K274Q/R355Q/K392N/K447_ | 5 | 6.76 | 7.46 | 8.02 | -0.63 |
| G137E/K274Q/R355Q/Q419E/K447_ | 5 | 6.76 | 7.46 | 8.02 | -0.63 |
| G137E/K274Q/K392N/Q419E/K447_ | 5 | 6.76 | 7.46 | 8.02 | -0.63 |
| G137E/R355Q/K392N/Q419E/K447_ | 5 | 6.76 | 7.46 | 8.02 | -0.63 |
| N203D/K274Q/R355Q/K392N/Q419E | 5 | 6.76 | 7.46 | 8.02 | -0.63 |
| N203D/K274Q/R355Q/K392N/K447_ | 5 | 6.76 | 7.46 | 8.02 | -0.63 |
| N203D/K274Q/R355Q/Q419E/K447_ | 5 | 6.76 | 7.46 | 8.02 | -0.63 |
| N203D/K274Q/K392N/Q419E/K447_ | 5 | 6.76 | 7.46 | 8.02 | -0.63 |
| N203D/R355Q/K392N/Q419E/K447_ | 5 | 6.76 | 7.46 | 8.02 | -0.63 |
| K274Q/R355Q/K392N/Q419E/K447_ | 5 | 6.76 | 7.46 | 8.02 | -0.63 |
| G137E/N203D/K274Q/R355Q | 4 | 7.00 | 7.61 | 8.02 | -0.51 |
| G137E/N203D/K274Q/K392N | 4 | 7.00 | 7.61 | 8.02 | -0.51 |
| G137E/N203D/K274Q/Q419E | 4 | 7.00 | 7.61 | 8.02 | -0.51 |
| G137E/N203D/K274Q/K447_ | 4 | 7.00 | 7.61 | 8.02 | -0.51 |
| G137E/N203D/R355Q/K392N | 4 | 7.00 | 7.61 | 8.02 | -0.51 |
| G137E/N203D/R355Q/Q419E | 4 | 7.00 | 7.61 | 8.02 | -0.51 |
| G137E/N203D/R355Q/K447_ | 4 | 7.00 | 7.61 | 8.02 | -0.51 |
| G137E/N203D/K392N/Q419E | 4 | 7.00 | 7.61 | 8.02 | -0.51 |
| G137E/N203D/K392N/K447_ | 4 | 7.00 | 7.61 | 8.02 | -0.51 |
| G137E/N203D/Q419E/K447_ | 4 | 7.00 | 7.61 | 8.02 | -0.51 |
| G137E/K274Q/R355Q/K392N | 4 | 7.00 | 7.61 | 8.02 | -0.51 |
| G137E/K274Q/R355Q/Q419E | 4 | 7.00 | 7.61 | 8.02 | -0.51 |
| G137E/K274Q/R355Q/K447_ | 4 | 7.00 | 7.61 | 8.02 | -0.51 |
| G137E/K274Q/K392N/Q419E | 4 | 7.00 | 7.61 | 8.02 | -0.51 |
| G137E/K274Q/K392N/K447_ | 4 | 7.00 | 7.61 | 8.02 | -0.51 |
| G137E/K274Q/Q419E/K447_ | 4 | 7.00 | 7.61 | 8.02 | -0.51 |
| G137E/R355Q/K392N/Q419E | 4 | 7.00 | 7.61 | 8.02 | -0.51 |
| G137E/R355Q/K392N/K447_ | 4 | 7.00 | 7.61 | 8.02 | -0.51 |

Figure 46B

| Variant | # of sub(s) | pI / pI | pI / WT | WT/ WT | avg delta pI |
|---|---|---|---|---|---|
| G137E/R355Q/Q419E/K447_ | 4 | 7.00 | 7.61 | 8.02 | -0.51 |
| G137E/K392N/Q419E/K447_ | 4 | 7.00 | 7.61 | 8.02 | -0.51 |
| N203D/K274Q/R355Q/K392N | 4 | 7.00 | 7.61 | 8.02 | -0.51 |
| N203D/K274Q/R355Q/Q419E | 4 | 7.00 | 7.61 | 8.02 | -0.51 |
| N203D/K274Q/R355Q/K447_ | 4 | 7.00 | 7.61 | 8.02 | -0.51 |
| N203D/K274Q/K392N/Q419E | 4 | 7.00 | 7.61 | 8.02 | -0.51 |
| N203D/K274Q/K392N/K447_ | 4 | 7.00 | 7.61 | 8.02 | -0.51 |
| N203D/K274Q/Q419E/K447_ | 4 | 7.00 | 7.61 | 8.02 | -0.51 |
| N203D/R355Q/K392N/Q419E | 4 | 7.00 | 7.61 | 8.02 | -0.51 |
| N203D/R355Q/K392N/K447_ | 4 | 7.00 | 7.61 | 8.02 | -0.51 |
| N203D/R355Q/Q419E/K447_ | 4 | 7.00 | 7.61 | 8.02 | -0.51 |
| N203D/K392N/Q419E/K447_ | 4 | 7.00 | 7.61 | 8.02 | -0.51 |
| K274Q/R355Q/K392N/Q419E | 4 | 7.00 | 7.61 | 8.02 | -0.51 |
| K274Q/R355Q/K392N/K447_ | 4 | 7.00 | 7.61 | 8.02 | -0.51 |
| K274Q/R355Q/Q419E/K447_ | 4 | 7.00 | 7.61 | 8.02 | -0.51 |
| K274Q/K392N/Q419E/K447_ | 4 | 7.00 | 7.61 | 8.02 | -0.51 |
| R355Q/K392N/Q419E/K447_ | 4 | 7.00 | 7.61 | 8.02 | -0.51 |
| G137E/N203D/K274Q | 3 | 7.30 | 7.74 | 8.02 | -0.36 |
| G137E/N203D/R355Q | 3 | 7.30 | 7.74 | 8.02 | -0.36 |
| G137E/N203D/K392N | 3 | 7.30 | 7.74 | 8.02 | -0.36 |
| G137E/N203D/Q419E | 3 | 7.30 | 7.74 | 8.02 | -0.36 |
| G137E/N203D/K447_ | 3 | 7.30 | 7.74 | 8.02 | -0.36 |
| G137E/K274Q/R355Q | 3 | 7.30 | 7.74 | 8.02 | -0.36 |
| G137E/K274Q/K392N | 3 | 7.30 | 7.74 | 8.02 | -0.36 |
| G137E/K274Q/Q419E | 3 | 7.30 | 7.74 | 8.02 | -0.36 |
| G137E/K274Q/K447_ | 3 | 7.30 | 7.74 | 8.02 | -0.36 |
| G137E/R355Q/K392N | 3 | 7.30 | 7.74 | 8.02 | -0.36 |
| G137E/R355Q/Q419E | 3 | 7.30 | 7.74 | 8.02 | -0.36 |
| G137E/R355Q/K447_ | 3 | 7.30 | 7.74 | 8.02 | -0.36 |
| G137E/K392N/Q419E | 3 | 7.30 | 7.74 | 8.02 | -0.36 |
| G137E/K392N/K447_ | 3 | 7.30 | 7.74 | 8.02 | -0.36 |
| G137E/Q419E/K447_ | 3 | 7.30 | 7.74 | 8.02 | -0.36 |
| N203D/K274Q/R355Q | 3 | 7.30 | 7.74 | 8.02 | -0.36 |
| N203D/K274Q/K392N | 3 | 7.30 | 7.74 | 8.02 | -0.36 |
| N203D/K274Q/Q419E | 3 | 7.30 | 7.74 | 8.02 | -0.36 |
| N203D/K274Q/K447_ | 3 | 7.30 | 7.74 | 8.02 | -0.36 |
| N203D/R355Q/K392N | 3 | 7.30 | 7.74 | 8.02 | -0.36 |
| N203D/R355Q/Q419E | 3 | 7.30 | 7.74 | 8.02 | -0.36 |
| N203D/R355Q/K447_ | 3 | 7.30 | 7.74 | 8.02 | -0.36 |
| N203D/K392N/Q419E | 3 | 7.30 | 7.74 | 8.02 | -0.36 |
| N203D/K392N/K447_ | 3 | 7.30 | 7.74 | 8.02 | -0.36 |
| N203D/Q419E/K447_ | 3 | 7.30 | 7.74 | 8.02 | -0.36 |
| K274Q/R355Q/K392N | 3 | 7.30 | 7.74 | 8.02 | -0.36 |
| K274Q/R355Q/Q419E | 3 | 7.30 | 7.74 | 8.02 | -0.36 |
| K274Q/R355Q/K447_ | 3 | 7.30 | 7.74 | 8.02 | -0.36 |
| K274Q/K392N/Q419E | 3 | 7.30 | 7.74 | 8.02 | -0.36 |
| K274Q/K392N/K447_ | 3 | 7.30 | 7.74 | 8.02 | -0.36 |
| K274Q/Q419E/K447_ | 3 | 7.30 | 7.74 | 8.02 | -0.36 |
| R355Q/K392N/Q419E | 3 | 7.30 | 7.74 | 8.02 | -0.36 |
| R355Q/K392N/K447_ | 3 | 7.30 | 7.74 | 8.02 | -0.36 |

Figure 46C

| Variant | # of sub(s) | pI / pI | pI / WT | WT / WT | avg delta pI |
|---|---|---|---|---|---|
| R355Q/Q419E/K447_ | 3 | 7.30 | 7.74 | 8.02 | -0.36 |
| K392N/Q419E/K447_ | 3 | 7.30 | 7.74 | 8.02 | -0.36 |
| G137E/N203D | 2 | 7.61 | 7.85 | 8.02 | -0.21 |
| G137E/K274Q | 2 | 7.61 | 7.85 | 8.02 | -0.21 |
| G137E/R355Q | 2 | 7.61 | 7.85 | 8.02 | -0.21 |
| G137E/K392N | 2 | 7.61 | 7.85 | 8.02 | -0.21 |
| G137E/Q419E | 2 | 7.61 | 7.85 | 8.02 | -0.21 |
| G137E/K447_ | 2 | 7.61 | 7.85 | 8.02 | -0.21 |
| N203D/K274Q | 2 | 7.61 | 7.85 | 8.02 | -0.21 |
| N203D/R355Q | 2 | 7.61 | 7.85 | 8.02 | -0.21 |
| N203D/K392N | 2 | 7.61 | 7.85 | 8.02 | -0.21 |
| N203D/Q419E | 2 | 7.61 | 7.85 | 8.02 | -0.21 |
| N203D/K447_ | 2 | 7.61 | 7.85 | 8.02 | -0.21 |
| K274Q/R355Q | 2 | 7.61 | 7.85 | 8.02 | -0.21 |
| K274Q/K392N | 2 | 7.61 | 7.85 | 8.02 | -0.21 |
| K274Q/Q419E | 2 | 7.61 | 7.85 | 8.02 | -0.21 |
| K274Q/K447_ | 2 | 7.61 | 7.85 | 8.02 | -0.21 |
| R355Q/K392N | 2 | 7.61 | 7.85 | 8.02 | -0.21 |
| R355Q/Q419E | 2 | 7.61 | 7.85 | 8.02 | -0.21 |
| R355Q/K447_ | 2 | 7.61 | 7.85 | 8.02 | -0.21 |
| K392N/Q419E | 2 | 7.61 | 7.85 | 8.02 | -0.21 |
| K392N/K447_ | 2 | 7.61 | 7.85 | 8.02 | -0.21 |
| Q419E/K447_ | 2 | 7.61 | 7.85 | 8.02 | -0.21 |
| G137E | 1 | 7.85 | 7.94 | 8.02 | -0.09 |
| N203D | 1 | 7.85 | 7.94 | 8.02 | -0.09 |
| K274Q | 1 | 7.85 | 7.94 | 8.02 | -0.09 |
| R355Q | 1 | 7.85 | 7.94 | 8.02 | -0.09 |
| K392N | 1 | 7.85 | 7.94 | 8.02 | -0.09 |
| Q419E | 1 | 7.85 | 7.94 | 8.02 | -0.09 |
| K447_ | 1 | 7.85 | 7.94 | 8.02 | -0.09 |

Figure 47

| Variant | # of sub(s) | pI / pI | pI / WT | WT/ WT | avg delta pI |
|---|---|---|---|---|---|
| Q196K/P217R/P228R/N276K/H435R | 5 | 8.53 | 8.32 | 8.02 | 0.25 |
| Q196K/P217R/P228R/N276K | 4 | 8.45 | 8.27 | 8.02 | 0.22 |
| Q196K/P217R/P228R/H435R | 4 | 8.46 | 8.28 | 8.02 | 0.22 |
| Q196K/P217R/N276K/H435R | 4 | 8.45 | 8.27 | 8.02 | 0.22 |
| Q196K/P228R/N276K/H435R | 4 | 8.45 | 8.27 | 8.02 | 0.22 |
| P217R/P228R/N276K/H435R | 4 | 8.46 | 8.28 | 8.02 | 0.22 |
| Q196K/P217R/P228R | 3 | 8.37 | 8.22 | 8.02 | 0.17 |
| Q196K/P217R/N276K | 3 | 8.37 | 8.22 | 8.02 | 0.17 |
| Q196K/P217R/H435R | 3 | 8.37 | 8.22 | 8.02 | 0.17 |
| Q196K/P228R/N276K | 3 | 8.37 | 8.22 | 8.02 | 0.17 |
| Q196K/P228R/H435R | 3 | 8.37 | 8.22 | 8.02 | 0.17 |
| Q196K/N276K/H435R | 3 | 8.37 | 8.22 | 8.02 | 0.17 |
| P217R/P228R/N276K | 3 | 8.37 | 8.22 | 8.02 | 0.17 |
| P217R/P228R/H435R | 3 | 8.37 | 8.22 | 8.02 | 0.18 |
| P217R/N276K/H435R | 3 | 8.37 | 8.22 | 8.02 | 0.17 |
| P228R/N276K/H435R | 3 | 8.37 | 8.22 | 8.02 | 0.17 |
| Q196K/P217R | 2 | 8.27 | 8.16 | 8.02 | 0.13 |
| Q196K/P228R | 2 | 8.27 | 8.16 | 8.02 | 0.13 |
| Q196K/N276K | 2 | 8.27 | 8.16 | 8.02 | 0.13 |
| Q196K/H435R | 2 | 8.27 | 8.16 | 8.02 | 0.13 |
| P217R/P228R | 2 | 8.28 | 8.16 | 8.02 | 0.13 |
| P217R/N276K | 2 | 8.27 | 8.16 | 8.02 | 0.13 |
| P217R/H435R | 2 | 8.28 | 8.16 | 8.02 | 0.13 |
| P228R/N276K | 2 | 8.27 | 8.16 | 8.02 | 0.13 |
| P228R/H435R | 2 | 8.28 | 8.16 | 8.02 | 0.13 |
| N276K/H435R | 2 | 8.27 | 8.16 | 8.02 | 0.13 |
| Q196K | 1 | 8.16 | 8.10 | 8.02 | 0.07 |
| P217R | 1 | 8.16 | 8.10 | 8.02 | 0.07 |
| P228R | 1 | 8.16 | 8.10 | 8.02 | 0.07 |
| N276K | 1 | 8.16 | 8.10 | 8.02 | 0.07 |
| H435R | 1 | 8.16 | 8.10 | 8.02 | 0.07 |

FIGURE 48A

| Target antigens for first or second monomer | FcRn variants | Scaffold | Fc variants | Combinations (See Legend D) |
|---|---|---|---|---|
| CD4 (T-cell surface glycoprotein CD4) | See Legend A | See Legend B | See Legend C | 1), 2), 3), 4), 5),6), 7), 8), 9) and 10) |
| CD25 (IL-2 receptor α-chain; IL-2Rα) | See Legend A | See Legend B | See Legend C | 1), 2), 3), 4), 5),6), 7), 8), 9) and 10) |
| CTLA4 (Cytotoxic T-lymphocyte protein 4; CD152) | See Legend A | See Legend B | See Legend C | 1), 2), 3), 4), 5),6), 7), 8), 9) and 10) |
| PD-1 (Programmed cell death protein 1; CD279) | See Legend A | See Legend B | See Legend C | 1), 2), 3), 4), 5),6), 7), 8), 9) and 10) |
| CCR4 (C-C chemokine receptor type 4; CD194) | See Legend A | See Legend B | See Legend C | 1), 2), 3), 4), 5),6), 7), 8), 9) and 10) |
| GITR (TNFRSF18; Tumor necrosis factor receptor superfamily member 18) | See Legend A | See Legend B | See Legend C | 1), 2), 3), 4), 5),6), 7), 8), 9) and 10) |
| LAG-3 (Lymphocyte activation gene 3 protein; CD223) | See Legend A | See Legend B | See Legend C | 1), 2), 3), 4), 5),6), 7), 8), 9) and 10) |
| CD62L (L-selectin, LECAM1) | See Legend A | See Legend B | See Legend C | 1), 2), 3), 4), 5),6), 7), 8), 9) and 10) |
| CD39 (ENTPD1; Ecto-nucleoside triphosphate diphosphohydrolase 1) | See Legend A | See Legend B | See Legend C | 1), 2), 3), 4), 5),6), 7), 8), 9) and 10) |
| CD44 | See Legend A | See Legend B | See Legend C | 1), 2), 3), 4), 5),6), 7), 8), 9) and 10) |
| MHCII/HLA-DR | See Legend A | See Legend B | See Legend C | 1), 2), 3), 4), 5),6), 7), 8), 9) and 10) |
| LAP | See Legend A | See Legend B | See Legend C | 1), 2), 3), 4), 5),6), 7), 8), 9) and 10) |
| CD103 (HML-1; integrin α-E) | See Legend A | See Legend B | See Legend C | 1), 2), 3), 4), 5),6), 7), 8), 9) and 10) |
| CCR5 (CD195; C-C chemokine receptor type 5) | See Legend A | See Legend B | See Legend C | 1), 2), 3), 4), 5),6), 7), 8), 9) and 10) |
| CCR6 (CD196; C-C chemokine receptor type 6) | See Legend A | See Legend B | See Legend C | 1), 2), 3), 4), 5),6), 7), 8), 9) and 10) |
| GARP (LRRC32; Leucine-rich repeat-containing protein 32) | See Legend A | See Legend B | See Legend C | 1), 2), 3), 4), 5),6), 7), 8), 9) and 10) |
| Galectin-1 (LGALS1) | See Legend A | See Legend B | See Legend C | 1), 2), 3), 4), 5),6), 7), 8), 9) and 10) |
| Galectin-10 | See Legend A | See Legend B | See Legend C | 1), 2), 3), 4), 5),6), 7), 8), 9) and 10) |
| Helios (Zinc finger protein Helios) | See Legend A | See Legend B | See Legend C | 1), 2), 3), 4), 5),6), 7), 8), 9) and 10) |
| TNFRSF25 (Tumor necrosis factor receptor superfamily member 25; DR3; Death receptor 3) | See Legend A | See Legend B | See Legend C | 1), 2), 3), 4), 5),6), 7), 8), 9) and 10) |
| Neuropilin-1 (Nrp1; CD304; Vascular endothelial cell growth factor 165 receptor; VEGF165R) | See Legend A | See Legend B | See Legend C | 1), 2), 3), 4), 5),6), 7), 8), 9) and 10) |
| GPR83 (G-protein coupled receptor 83) | See Legend A | See Legend B | See Legend C | 1), 2), 3), 4), 5),6), 7), 8), 9) and 10) |

FIGURE 48B

| Target antigens for first or second monomer | FcRn variants | Scaffold | Fc variants | Combinations (See Legend D) |
|---|---|---|---|---|
| CD26 (Dipeptidyl peptidase 4; DPP IV ectoenzyme) | See Legend A | See Legend B | See Legend C | 1), 2), 3), 4), 5),6), 7), 8), 9) and 10) |
| CD45RA | See Legend A | See Legend B | See Legend C | 1), 2), 3), 4), 5),6), 7), 8), 9) and 10) |
| CD45RO | See Legend A | See Legend B | See Legend C | 1), 2), 3), 4), 5),6), 7), 8), 9) and 10) |
| CD49d (VLA-4α; Integrin α4) | See Legend A | See Legend B | See Legend C | 1), 2), 3), 4), 5),6), 7), 8), 9) and 10) |
| CD101 (Immunoglobulin superfamily member 2; IGSF2; V7) | See Legend A | See Legend B | See Legend C | 1), 2), 3), 4), 5),6), 7), 8), 9) and 10) |
| Folate receptor 4 (FR4) | See Legend A | See Legend B | See Legend C | 1), 2), 3), 4), 5),6), 7), 8), 9) and 10) |
| CD31 (PECAM-1; platelet endothelial cell adhesion molecule) | See Legend A | See Legend B | See Legend C | 1), 2), 3), 4), 5),6), 7), 8), 9) and 10) |
| CD137 (Tumor necrosis factor receptor superfamily member 9; TNFRSF9) | See Legend A | See Legend B | See Legend C | 1), 2), 3), 4), 5),6), 7), 8), 9) and 10) |
| OX40 (CD134; Tumor necrosis factor receptor superfamily member 4; TNFRSF4) | See Legend A | See Legend B | See Legend C | 1), 2), 3), 4), 5),6), 7), 8), 9) and 10) |

Anti-Treg target 1

Anti-Treg target 2

Target 1 = CD4, CD25, CTLA4, PD-1, CCR4, CD39, CCR6, TIM-3, LAG-3, GITR, etc.

Target 2 = CD4, CD25, CTLA4, PD-1, CCR4, CD39, CCR6, TIM-3, LAG-3, GITR, etc.

Fc = IgG1, S239D/I332E (high ADCC), or G236R/L328F (no effector function)

FIGURE 50A

XENP15205 (OKT4A H1.1_L1 x Anti-TAC H1_L1.11 scFv High ADCC S239D/I332E bispecific)

Monomer 1 (OKT4A_H1.1_IgG1_pI(-)_Isosteric_A_S239D/I332E/L368D/K370S)

EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGAYD
PFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKC
KVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHE
ALHNHYTQKSLSLSPGK (SEQ ID NO:288)

vhCDR1: NYAMS (SEQ ID NO: 289)
vhCDR2: AISDHSTNTYYPDSVKG (SEQ ID NO: 290)
vhCDR3: KYGGAYDPFDY (SEQ ID NO: 291)

vh:
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGAYDPFD
YWGQGTLVTVSS (SEQ ID NO: 292)

Monomer 2 (Anti-TAC_H1_L1.11_scFv(GKPGS)4_Fc(216)_IgG1_C220S_S239D/I332E/S364K/E357Q)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGKPGSQIVLTQSPATLSLSPGERATLSCRASSSISYMHWFQQKPGQSPQLLIYDTSNLASGVPARFSGSGSGTDYTLTISSL
QPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEEKTISKAKGQPRENNYKTTPPVLDSDGSFF
LYSKLTVDKSRWQQGNVFSCSVMHEALHNHYTQKSLSLSPGK (SEQ ID NO: 293)

vhCDR1: SYRMH (SEQ ID NO: 294)
vhCDR2: YINPSTGYTEYNQKFQG (SEQ ID NO: 295)
vhCDR3: GGGVFDY (SEQ ID NO: 296)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYW
GQGTLVTVSS (SEQ ID NO: 297)

vlCDR1: RASSSISYMH (SEQ ID NO: 298)
vlCDR2: DTSNLAS (SEQ ID NO: 299)
vlCDR3: HQRSTYPLT (SEQ ID NO: 300)

vl:
QIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIK (SEQ ID NO: 301)

scFv:
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYW
GQGTLVTVSSGKPGSGKPGSGKPGSQIVLTQSPATLSLSPGERATLSCRASSSISYMHWFQQKPGQSPQLLIYDTSNLASGVPARFSGSGSGTDYTLTISSLQPED
FAVYYCHQRSTYPLTFGSGTKLEIK (SEQ ID NO: 302)

Light chain (OKT4A_L1)
DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 303)

vlCDR1: CQASQDINNYIA (SEQ ID NO: 304)
vlCDR2: YTSTLQP (SEQ ID NO: 305)
vlCDR3: LQYDNLLFT (SEQ ID NO: 306)

vl:
DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIK (SEQ ID NO: 307)

FIGURE 50B

XENP15189 (mAb1567 H1.1_L1.1 x Anti-TAC H1_L1.11 scFv High ADCC S239D/I332E bispecific)

Monomer 1 (mAb1567 H1.1_L1.1 Heavy chain)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSREEMTKNQVSLTCDVSGFFLYSKLTVDKSRWEQGDVFSCSVMHEAL
HNHYTQKSLSLSPGK (SEQ ID NO: 308)

vhCDR1: SYYIQ (SEQ ID NO: 309)
vhCDR2: WINPGNVNTKYNEKFQ (SEQ ID NO: 310)
vhCDR3: STYYRPLDY (SEQ ID NO: 311)

vh:
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPLDY
WGQGTTVTVSS (SEQ ID NO: 312)

Monomer 2 (Anti-TAC H1_L1.11 scFv Heavy chain)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGKPGSQIVLTQSPATLSLSPGERATLSCRASSSISYMHWFQQKPGQSPQLLIYDTSNLASGVPARFSGSGSGTDYTLTISSL
QPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 293)

vhCDR1: SYRMH (SEQ ID NO: 294)
vhCDR2: YINPSTGYTEYNQKFQG (SEQ ID NO: 295)
vhCDR3: GGGVFDY (SEQ ID NO: 296)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYW GQGTLVTVSS (SEQ ID NO: 297)

vLCDR1: RASSSISYMH (SEQ ID NO: 298)
vLCDR2: DTSNLAS (SEQ ID NO: 299)
vLCDR3: HQRSTYPLT (SEQ ID NO: 300)

vl:
QIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIK (SEQ ID NO: 301)

scFv:
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYW GQGTLVTVSSGKPGSGKPGSGKPGSGKPGSQIVLTQSPATLSLSPGERATLSCRASSSISYMHWFQQKPGQSPQLLIYDTSNLASGVPARFSGSGSGTDYTLTISSLQPED FAVYYCHQRSTYPLTFGSGTKLEIK (SEQ ID NO: 302)

mAb1567 H1.1 L1.1 Light chain

DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLEIKR TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 313)

vLCDR1: KSSQSILYSSNQKNYLA (SEQ ID NO: 314)
vLCDR2: WASTRES (SEQ ID NO: 315)
vLCDR3: HQYLSSY (SEQ ID NO: 316)

vl:
DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLE IK (SEQ ID NO: 317)

FIGURE 50C

XENP16791 (mAb1567 H1.112_L1.26 x Anti-TAC H1_L1.11 scFv High ADCC S239D/I332E bispecific)

Monomer 1 (mAb1567_H1.112_IgG1_pI(-)_Isosteric_A_S239D/I332E/L368D/K370S)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSREEMTKNQVSLTCLVKGFYPSDIAVEWESDGSFFLYSKLTVDKSRWEQGDVFSCSVMHEAL
HNHYTQKSLSLSPGK (SEQ ID NO: 318)

vhCDR1: SYYIQ (SEQ ID NO: 319)
vhCDR2: WINPGNVNTKYNEKFQG (SEQ ID NO: 320)
vhCDR3: STYYIPLDY (SEQ ID NO: 321)

vh:
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPLDYW
GQGTTVTVSS (SEQ ID NO: 322)

Monomer 2 (Anti-TAC_H1_L1.11_scFv(GKPGS)4_Fc(216)_IgG1_C220S_S239D/I332E/S364K/E357Q)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGKPGSQIVLTQSPATLSLSPGERATLSCRASSSISYMHWFQQKPGQSPQLLIYDTSNLASGVPARFSGSGSGTDYTLTISSL
QPEDFAVYYCHQRSTYPLITFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 293)

vhCDR1: SYRMH (SEQ ID NO: 294)
vhCDR2: YINPSTGYTEYNQKFQG (SEQ ID NO: 295)
vhCDR3: GGGVFDY (SEQ ID NO: 296)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYW
GQGTLVTVSS (SEQ ID NO: 297)

vLCDR1: RASSISYMH (SEQ ID NO: 298)
vLCDR2: DTSNLAS (SEQ ID NO: 299)
vLCDR3: HQRSTYPLT (SEQ ID NO: 300)

vl:
QIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIK (SEQ ID
NO: 301)

scFv:
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYW
GQGTLVTVSSGKPGSGKPGSGKPGSGKPGSQIVLTQSPATLSLSPGERATLSCRASSSISYMHWFQQKPGQSPQLLIYDTSNLASGVPARFSGSGSGTDYTLTISSLQPED
FAVYYCHQRSTYPLTFGSGTKLEIK (SEQ ID NO: 302)

Light chain (mAb1567_L1.26)
DIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC
(SEQ ID NO: 323)

vLCDR1: KSSQSILYSKNQKNYLA (SEQ ID NO: 324)
vLCDR2: WASTRES (SEQ ID NO: 325)
vLCDR3: HQYLSSYT (SEQ ID NO: 326)

vl:
DIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLEIK
(SEQ ID NO: 327)

FIGURE 50D

XENP15193 (ipilimumab H0L0 x Anti-TAC H1_L1.11 scFv High ADCC S239D/I332E bispecific)

Monomer 1 (ipilimumab H0L0 Heavy chain)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEAL
HNHYTQKSLSLSPGK (SEQ ID NO: 328)

vhCDR1: SYTMH (SEQ ID NO: 329)
vhCDR2: FISYDGNNKYYADSVKG (SEQ ID NO: 330)
vhCDR3: TGWLGPFDY (SEQ ID NO: 331)

vh:
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDY
WGQGTLVTVSS (SEQ ID NO: 332)

Monomer 2 (Anti-TAC H1_L1.11 scFv Heavy chain)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSSQIVLTQSPATLSLSPGERATLSCRASSSISYMHWFQQKPGQSPQLLIYDTSNLASGVPARFSGSGSGTDYTLTISSL
QPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 293)

vhCDR1: SYRMH (SEQ ID NO: 294)
vhCDR2: YINPSTGYTEYNQKFQG (SEQ ID NO: 295)
vhCDR3: GGGVFDY (SEQ ID NO: 296)

FIGURE 50D continued vh:
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYW
GQGTLVTVSS (SEQ ID NO: 297)

vLCDR1: RASSSISYMH (SEQ ID NO: 298)
vLCDR2: DTSNLAS (SEQ ID NO: 299)
vLCDR3: HQRSTYPLT (SEQ ID NO: 300)

vl:
QIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIK (SEQ ID NO: 301)

scFv:
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYW
GQGTLVTVSSGKPGSSGKPGSSGKPGSSQIVLTQSPATLSLSPGERATLSCRASSSISYMHWFQQKPGQSPQLLIYDTSNLASGVPARFSGSGSGTDYTLTISSLQPED
FAVYYCHQRSTYPLTFGSGTKLEIK (SEQ ID NO: 302)

Ipilimumab HOLO light chain

EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ
ID NO: 333)

vLCDR1: RASQSVGSSYLA (SEQ ID NO: 334)
vLCDR2: GAFSRAT (SEQ ID NO: 335)
vLCDR3: QQYGSSPWT (SEQ ID NO: 336)

vl:
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK (SEQ ID NO: 337)

FIGURE 50E

XENP15836 (ipilimumab x Anti-TAC_H1.6_L1.71 scFv High ADCC S239D/I332E bispecific)

Monomer 1 (ipilimumab_H0_IgG1_pI(-)_Isosteric_A_S239D/I332E/L368D/K370S)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSDGSFFLYSKLTVDKSRWEQGDVFSCSVMHEAL
HNHYTQKSLSLSPGK (SEQ ID NO: 338)

vhCDR1: SYTMH (SEQ ID NO: 339)
vhCDR2: FISYDGNNKYYADSVKG (SEQ ID NO: 340)
vhCDR3: TGWLGPFDY (SEQ ID NO: 341)

vh:
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDY
WGQGTLVTVSS (SEQ ID NO: 342)

Monomer 2 (Anti-TAC_H1.6_L1.71_scFv(GKPGS)4_Fc(216)_IgG1_C220S_S239D/I332E/S364K/E357Q)

QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGKPGSQIVLTQSPATLSLSPGERATLSCRASSSISYMHWFQQKPGQSPQLLIYDASNLASGVPARFSGSGSGTDYTLTISSL
QPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 343)

vhCDR1: SYYMH (SEQ ID NO: 344)
vhCDR2: YINPSTGYTEYNQKFQG (SEQ ID NO: 345)
vhCDR3: GGGVFDY (SEQ ID NO: 346)

QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFDYW
GQGTLVTVSS (SEQ ID NO: 347)

vLCDR1: RASSSISYMH (SEQ ID NO: 348)
vLCDR2: DASNLAS (SEQ ID NO: 349)
vLCDR3: HQRSTYPLT (SEQ ID NO: 350)

vl:
QIVLTQSPATLSLSPGERATLSCRASSSISYMHWFQQKPGQSPQLLIYDASNLASGVPARFSGSGSGTDYTLTISSLQPEDFAVYYCHQRSTYPLTFGSGTKLEIK (SEQ ID
NO: 351)

scFv:
QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFDYW
GQGTLVTVSSGKPGSSGKPGSSGKPGSGKPGSQIVLTQSPATLSLSPGERATLSCRASSSISYMHWFQQKPGQSPQLLIYDASNLASGVPARFSGSGSGTDYTLTISSLQPED
FAVYYCHQRSTYPLTFGSGTKLEIK (SEQ ID NO: 352)

Light chain (Ipilimumab_L0)

EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ
ID NO: 333)

vLCDR1: RASQSVGSSYLA (SEQ ID NO: 334)
vLCDR2: GAFSRAT (SEQ ID NO: 335)
vLCDR3: QQYGSSPWT (SEQ ID NO: 336)

vl:
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK (SEQ
ID NO: 337)

FIGURE 50F

XENP16667 (Tremelimumab_H0L0 x mAb1567_H1.112_L1.26 scFv High ADCC S239D/I332E bispecific)

Monomer 1 (Tremelimumab_H0_IgG1_pI(-)_Isosteric_A_S239D/I332E/L368D/K370S)

QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGA
TLYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHK
PSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWL
NGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 353)

vhCDR1: SYGMH (SEQ ID NO: 354)
vhCDR2: VIWYDGSNKYYADSVKG (SEQ ID NO: 355)
vhCDR3: DPRGATLYYYYGMDV (SEQ ID NO: 356)

vh:
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYY
YYYGMDVWGQGTTVTVSS (SEQ ID NO: 357)

Monomer 2 (mAb1567_H1.112_L1.26_scFv(GKPGS)4_Fc(216)_IgG1_C220S_S239D/I332E/S364K/E357Q)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPL
DYWGQGTTVTVSSGKPGSGKPGSGKPGSGKPGSDIELTQSPDSLAVSLGERATINCKSSQSILYSKNQKNYLAWYQQKPGQSPKLLIYWASTRESGVPDRFTGSGSG
TDFTLTISSLEAEDVAVYYCHQYLSSYTFGGGTKLEIKEPKSSDKTHTCPPCPAPELLGGPDVFLFPPKPKDTLMISRTPEVTCVVVDVSHEDPEVKFNWYVDGVEVHNAK
TKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO: 358)

vhCDR1: SYYIQ (SEQ ID NO: 359)
vhCDR2: WINPGNVNTKYNEKFQG (SEQ ID NO: 360)
vhCDR3: STYYIPLDY (SEQ ID NO: 361)

FIGURE 50F continued vh:
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPLDYW
GQGTTVTVSS (SEQ ID NO: 362)

vLCDR1: KSSQSILYSKNQKNYLA (SEQ ID NO: 363)
vlCDR2: WASTRES (SEQ ID NO: 364)
vlCDR3: HQYLSSYT (SEQ ID NO: 365)

vl:
DIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLEIK
(SEQ ID NO: 366)

scFv:
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPLDYW
GQGTTVTVSSGPGSGKPGSGKPGSGKPGSDIELTQSPDSLAVSLGERATINCKSSQSILYSKNQKNYLAWYQQKPGQSPKLLIYWASTRESGVPDRFTGSGSGTDFTLTI
SSLEAEDVAVYYCHQYLSSYTFGGGTKLEIK (SEQ ID NO: 367)

Light chain (Tremelimumab_L0)
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID
NO: 368)

vlCDR1: RASQSINSYLD (SEQ ID NO: 369)
vlCDR2: AASSLQSS (SEQ ID NO: 370)
vlCDR3: QQYYSTPFTF (SEQ ID NO: 371)

vl:
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK (SEQ ID
NO: 372)

FIGURE 51A

XENP15449 (Anti-TAC_H1_L1.11 Hybrid S239D/I332E)

Heavy chain

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV EPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKCKV SNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEAL HNHYTQKSLSLSPGK (SEQ ID NO: 373)

Light chain

QIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIKRTVAA PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 374)

FIGURE 51B

XENP14482 (mAb1567_H1L1 Hybrid S239D/I332E)

Heavy chain

QVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRP
LDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDK
KVEPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKC
KVSNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHE
ALHNHYTQKSLSLSPGK (SEQ ID NO: 375)

Light chain

DIELTQSPDSLAVSLGERATINCKSSQSILYSSNQKNYLAWYQQKPGQSPKLLIYWASTRESGVPDRFTGSGSGTDFTLTISSLQAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC
(SEQ ID NO: 376)

FIGURE 51C

XENP6369 (daclizumab IgG1)

Heavy chain

QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDY
WGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVE
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSN
KALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHN
HYTQKSLSLSPGK (SEQ ID NO: 377)

Light chain

DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID
NO: 378)

FIGURE 51D

XENP14058 (daclizumab FcKO)

Heavy chain

QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDY
WGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVE
PKSCDKTHTCPPCPAPELLRGPSVFLFPPKPKDTLMISRTPEVTCVVVDVSHEDPEVKFNWYVDGVEVHNAKTKPREEQYNSTYRVVSVLTVLHQDWLNGKEYKCKVSN
KARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHN
HYTQKSLSLSPGK (SEQ ID NO: 379)

Light chain

DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID
NO: 380)

FIGURE 51E

XENP6428 (Anti-TAC H1_L1.11 IgG1)

Heavy chain

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVS NKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALH NHYTQKSLSLSPGK (SEQ ID NO: 381)

Light chain

QIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIKRTVAA PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 382)

FIGURE 51F

XENP18977 (Anti-TAC H1.6_L1.71 IgG1)

Heavy chain

QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFD YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVS NKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALH NHYTQKSLSLSPGK (SEQ ID NO: 383)

Light chain

QIVLTQSPATLSLSPGERATLSCRASSSISYMHWFQQKPGQSPQLLIYDASNLASGVPARFSGSGSGTDYTLTISSLQPEDFAVYYCHQRSTYPLTFGSGTKLEIKRTVA APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 384)

FIGURE 51G

XENP15610 (Anti-TAC H1.6_L1.71 Hybrid S239D/I332E)

Heavy chain

**QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFD
YWGQGTLVTVSS**ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV
EPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKCKV
SNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEAL
HNHYTQKSLSLSPGK (SEQ ID NO: 385)

Light chain

QIVLTQSPATLSLSPGERATLSCRASSSISYMHWFQQKPGQSPQLLIYDASNLASGVPARFSGSGSGTDYTLTISSLQPEDFAVYYCHQRSTYPLITFGSGTKLEIKRTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID
NO: 386)

FIGURE 51H

XENP016282 Anti-CD4 x Anti-CD39 High ADCC bispecific (OKT4A_H1L1 x mAbBA54g_H1L1)

Heavy chain 1 (OKT4A_H1_IgG1_pI(-)_isosteric_A_S239D/I332E/L368D/K370S)

EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYD
PFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKC
KVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGNVFSCSVMHE
ALHNHYTQKSLSLSPGK (SEQ ID NO: 387)

Heavy chain 2 (mAbBA54g_H1L1_scFv(GKPG)4_Fc(216)_IgG1_C220S_S239D/I332E/S364K/E357Q)

QVQLVESGGGLVQPGGSLRLSCAASGFTFSSFGMHWVRQAPGKGLEWVSYISSGSSIIYYADSRKGRFTISRDNAKNSLYLQMNSLRAEDTAVYYCARWSTTVVAT
DYWGQGTTVTVSSGKPGSGKPGSGKPGSGKPGSNIVMTQSPATLSVSPGERATLSCRASENVTYVSWYQQKPGQSPRLLIYGASNRYTGVPDRFTGSGSATDFTL
TISSLQPEDFAVYHCGQGYSYPYTFGGGTKLEIKEPKSSDKTHTCPPCPAPELLGGPDVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 388)

Light chain (OKT4A_L1)

DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID
NO: 389)

FIGURE 51I

XENP020047 Anti-CD4 x Anti-CD39 IgG1 bispecific (OKT4A_H1L1 x mAbBA54g_H1L1)

Heavy chain 1 (OKT4A_H1_IgG1_pI(-)_Isosteric_A_L368D/K370S)

EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYD
PFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKC
KVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEA
LHNHYTQKSLSLSPGK (SEQ ID NO: 390)

Heavy chain 2 (mAbBA54g_H1L1_scFv(GKPGS)4_Fc(216)_IgG1_C220S_/S364K/E357Q)

QVQLVESGGGLVQPGGSLRLSCAASGFTFSSFGMHWVRQAPGKGLEWVSYISSGSSIIYYADSRKGRFTISRDNAKNSLYLQMNSLRAEDTAVYYCARWSTTVVAT
DYWGQGTTVTVSSGKPGSGKPGSGKPGSGKPGSNIVMTQSPATLSCRASENVVTYVSWYQQKPGQSPRLLIYGASNRYTGVPDRFTGSGSATDFTL
TISSLQPEDFAVYHCGQGYSYPYTFGGGTKLEIKEPKSSDKTHTCPPCPAPELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 391)

Light chain (OKT4A_L1)

DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 392)

FIGURE 51J

XENP016283 Anti-CCR4 x Anti-CD39 High ADCC bispecific (mAb1567_H1.1_L1.1 x mAbBA54g_H1L1)

Heavy chain 1 (mAb1567_H1.1_IgG1_pI(-)_isosteric_A_S239D/I332E/L368D/K370S)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSREEMTKNQVSLTCDVSDGSFFLYSKLTVDKSRWEQGDVFSCSVMHEAL
HNHYTQKSLSLSPGK (SEQ ID NO: 393)

Heavy chain 2 (mAbBA54g_H1L1_scFv(GKPGS)4_Fc(216)_IgG1_C220S_S239D/I332E/S364K/E357Q)

QVQLVESGGGLVQPGGSLRLSCAASGFTFSSFGMHWVRQAPGKGLEWVSYISSGSSIIYYADSRKGRFTISRDNAKNSLYLQMNSLRAEDTAVYYCARWSTTVVAT
DYWGQGTTVTVSSGKPGSGKPGSGKPGSNIVMTQSPATLSVSPGERATLSCRASENVVTYVSWYQQKPGQSPRLLIYGASNRYTGVPDRFTGSGSATDFTL
TISSLQPEDFAVYHCGQGYSYPYTFGGGTKLEIKEPKSSDKTHTCPPCPAPELLGGPDVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 394)

Light chain (mAb1567_L1.1)

DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 395)

FIGURE 51K

XENP020046 (Anti-CCR4 x Anti-CD39 High ADCC bispecific (mAb1567_H1.112_L1.26 x mAbBA54g_H1L1)

Heavy chain 1 (mAb1567_H1.112_IgG1_pI(-)_Isosteric_A_S239D/I332E/L368D/K370S)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSREEMTKNQVSLTCDVSGFFLYSKLTVDKSRWEQGDVFSCSVMHEAL
HNHYTQKSLSLSPGK (SEQ ID NO: 396)

Heavy chain 2 (mAbBA54g_H1L1_scFv(GKPGS)4_Fc(216)_IgG1_C220S_S239D/I332E/S364K(/E357Q)

QVQLVESGGGLVQPGGSLRLSCAASGFTFSSFGMHWVRQAPGKGLEWVSYISSGSSIHYYADSRKGRFTISRDNAKNSLYLQMNSLRAEDTAVYYCARWSTTVVAT
DYWGQGTTVTVSSGKPGSGKPGSGKPGSGKPGSNIVMTQSPATLSVSPGERATLSCRASENVVTYVSWYQQKPGQSPRLLIYGASNRYTGVPDRFTGSGSATDFTL
TISSLQPEDFAVYHCGQGYSYPYTFGGGTKLEIKEPKSSDKTHTCPPCPAPELLGGPDVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 397)

Light chain (mAb1567_L1.26)

DIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 398)

FIGURE 51L

XENP016284 Anti-CTLA4 x Anti-CD39 High ADCC bispecific (ipilimumab x mAbBA54g_H1L1)

Heavy chain 1 (ipilimumab_H0_IgG1_pI(-)_Isosteric_A_S239D/I332E/L368D/K370S)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKV
SNKALPAPEEKTISKAKGQPREPQVYTLPPSREEMTKNQVSLTCDVSGFYPSDIAVEWESDGQPENNYKTTPPVLDSDGSFFLYSKLTVDKSRWQEGDVFSCSVMHEAL
HNHYTQKSLSLSPGK (SEQ ID NO: 399)

Heavy chain 2 (mAbBA54g_H1L1_scFv(GKPGS)4_Fc(216)_IgG1_C220S_S239D/I332E/S364K/E357Q)

QVQLVESGGGLVQPGGSLRLSCAASGFTFSSFGMHWVRQAPGKGLEWVSYISSGSSIIYYADSRKGRFTISRDNAKNSLYLQMNSLRAEDTAVYYCARWSTTVVAT
DYWGQGTTVTVSSGKPGSGKPGSGKPGSGKPGSNIVMTQSPATLSVSPGERATLSCRASENVVTYVSWYQQKPGQSPRLLIYGASNRYTGVPDRFTGSGSATDFTL
TISSLQPEDFAVYHCGQGYSYPYTFGGGTKLEIKEPKSSDKTHTCPPCPAPELLGGPDVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 400)

Light chain (ipilimumab_L0)

EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 401)

FIGURE 51M

XENP020049 Anti-CTLA4 x Anti-CD39 IgG1 bispecific (ipilimumab x mAbBA54g_H1L1)

Heavy chain 1 (ipilimumab_H0_IgG1_pI(-)_Isosteric_A_L368D/K370S)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPIEKTISKAKGQPREPQVYTLPPSREEMTKNQVSLTCDVSGFFLYSKLTVDKSRWEQGDVFSCSVMHEALH
NHYTQKSLSLSPGK (SEQ ID NO: 402)

Heavy chain 2 (mAbBA54g_H1L1_scFv(GKPGS)4_Fc(216)_IgG1_C220S_/S364K/E357Q)

QVQLVESGGGLVQPGGSLRLSCAASGFTFSSFGMHWVRQAPGKGLEWVSYISSGSSIIYADSRKGRFTISRDNAKNSLYLQMNSLRAEDTAVYYCARWSTTVVAT
DYWGQGTTVTVSSGKPGSGKPGSGKPGSGKPGSNIVMTQSPATLSVSPGERATLSCRASENVVTYVSWYQQKPGQSPRLLIYGASNRYTGVPDRFTGSGSATDFTL
TISSLQPEDFAVYHCGQGYSYPYTFGGGTKLEIKEPKSSDKTHTCPPCPAPELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVVTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 403)

Light chain (ipilimumab_L0)

EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 404)

FIGURE 51N

XENP020048 Anti-CCR4 x Anti-CD39 IgG1 bispecific (mAb1567_H1.112_L1.26 (high affinity) x mAbBA54g_H1L1)

Heavy chain 1 (mAb1567_H1.112_IgG1_pI(-)_Isosteric_A_L368D/K370S)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK (SEQ ID NO: 405)

Heavy chain 2 (mAbBA54g_H1L1_scFv(GKPGS)4_Fc(216)_IgG1_C220S_/S364K/E357Q)

QVQLVESGGGLVQPGGSLRLSCAASGFTFSSFGMHWVRQAPGKGLEWVSYISSGSSIIYYADSRKGRFTISRDNAKNSLYLQMNSLRAEDTAVYYCARWSTTVVAT
DYWGQGTTVTVSSGKPGSGKPGSGKPGSNIVMTQSPATLSVSPGERATLSCRASENVVTYVSWYQQKPGQSPRLLIYGASNRYTGVPDRFTGSGSATDFTL
TISSLQPEDFAVYHCGQGYSPYTFGGGTKLEIKEPKSSDKTHTCPPCPAPELLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 406)

Light chain (mAb1567_L1.26)

DIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 407)

FIGURE 510

XENP016257 Anti-CD25 x Anti-CCR6 High ADCC bispecific (Anti-TAC_H1L1 x mAb612_H0L0)

Heavy chain 1 (Anti-TAC_H1_IgG1_pI(-)_Isosteric_A_S239D/I332E/L368D/K370S)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV EPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVS NKALPAPEEKTISKAKGQPREPQVYTLPPSREEMTKNQVSLTCDVSGFYPSDIAVEWESDGQPENNYKTTPPVLDSDGSFFLYSKLTVDKSRWQEGNVFSCSVMHEALH NHYTQKSLSLSPGK (SEQ ID NO: 408)

Heavy chain 2 (mAb612_H0L0_scFv(GKPGS)4_Fc(216)_IgG1_C220S_S239D/I332E/S364K/E357Q)

EVQLLGSGGGLVQPGGSLRLSCAASGFTFTTYYMHWVRQAPGKGLEWVSLISPNAGNTYYADSVKGRFTISRDNSKNTLYLQMNSLRAEDTAVYYCARGRSRAGTI SGMDYWGQGTLVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTD FTLTISRLEPEDFAVYYCQQAASSPITFGQGTKVEIKEPKSSDKTHTCPPCPAPELLGGPDVFLFPPKPKDTLMISRTPEVTCVVVDVSHEDPEVKFNWYVDGVEHNAKT KPREEQYNSTYRVVSVLTVLHQDWLNGKEYKCKVSNKALPAPIEEKTISKAKGQPREPQVYTLPPSREQMTKNQVKLTCLVKGFYPSDIAVEWESNGQPENNYKTTPPVL DSDGSFFLYSKLTVDKSRWQQGNVFSCSVMHEALHNHYTQKSLSLSPGK (SEQ ID NO: 409)

Light chain (anti-TAC_L1)

QIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKRTVAA PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 410)

FIGURE 51P

XENP016258 Anti-CD25 x Anti-CCR6 FcKO bispecific (Anti-TAC_H1L1 x mAb612_H0L0)

Heavy chain 1 (Anti-TAC_H1_IgG1_pI(-)_Isosteric_A_PVA_/S267K/L368D/K370S)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGVFD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV
EPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHN
HYTQKSLSLSPGK (SEQ ID NO: 411)

Heavy chain 2 (mAb612_H0L0_scFv(GKPGS)4_Fc(216)_IgG1_C220S/PVA_/S267K/S364K/E357Q)

EVQLLGSGGGLVQPGGSLRLSCAASGFTFTTYYMHWVRQAPGKGLEWVSLISPNAGNTYYADSVKGRFTISRDNSKNTLYLQMNSLRAEDTAVYYCARGRSRAGT
SGMDYWGQGTLVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTD
FTLTISRLEPEDFAVYYCQQAASSPITFGQGTKVEIKEPKSSDKTHTCPPCPAPPVAGPSVFLFPPKPKDTLMISRTPEVTCVVVDVKHEDPEVKFNWYVDGVEVHNAKT
KPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 412)

Light chain (anti-TAC_L1)

QIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKRTVAA
PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 413)

FIGURE 51Q

XENP016259 Anti-CTLA4 x Anti-CCR6 High ADCC bispecific (ipilimumab x mAb612_H0L0)

Heavy chain 1 (ipilimumab_H0_IgG1_pI(-)_Isosteric_A_S239D/I332E/L368D/K370S)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPVLDSDGSFFLYSKLTVDKSRWEQGDVFSCSVMHEAL
HNHYTQKSLSLSPGK (SEQ ID NO: 414)

Heavy chain 2 (mAb612_H0L0_scFv(GKPGS)4_Fc(216)_IgG1_C220S_S239D/I332E/S364K/E357Q)

EVQLLGSGGGLVQPGGSLRLSCAASGFTFTTYYMHWVRQAPGKGLEWVSLISPNAGNTYYADSVKGRFTISRDNSKNTLYLQMNSLRAEDTAVYYCARGRSRAGT
SGMDYWGQGTLVTVSSGKPGSGKPGSGKPGSEIVLTQSPGTLSLSPGERATLSCRASQSVSSSYLAWYQQKPGQAPRLLIYGASSRATGIPDRFSGSGSGTD
FTLTISRLEPEDFAVYYCQQYGSSPWTFGQGTKVEIKEPKSSDKTHTCPPCPAPELLGGPDVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEEKTISKAKGQPREPQVYTLPPSREQMTKNQVSLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 415)

Light chain (ipilimumab_L0)

EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 416)

FIGURE 51R

XENP016260 Anti-CTLA4 x Anti-CCR6 FcKO bispecific (ipilimumab x mAb612_H0L0)

Heavy chain 1 (ipilimumab_H0_IgG1_pI(-)_Isosteric_A_PVA_/S267K/L368D/K370S)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFFLYSKLTVDKSRWEQGDVFSCSVMHEALH
NHYTQKSLSLSPGK (SEQ ID NO: 417)

Heavy chain 2 (mAb612_H0L0_scFv(GKPGS)4_Fc(216)_IgG1_C220S/PVA_/S267K/S364K/E357Q)

EVQLLGSGGGLVQPGGSLRLSCAASGFTFTTYYMHWVRQAPGKGLEWVSLLSPNAGNTYYADSVKGRFTISRDNSKNTLYLQMNSLRAEDTAVYYCARGRSRAGT
SGMDYWGQGTLVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTD
FTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKT
KPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 418)

Light chain (ipilimumab_L0)

EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 419)

FIGURE 51S

XENP016261 Anti-CCR4 x Anti-CCR6 High ADCC bispecific (mAB1567_H1.1_L1.1 x mAb612_H0L0)

Heavy chain 1 (mAb1567_H1.1_IgG1_pI(-)_isosteric_A_S239D/I332E/L368D/K370S)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSREEMTKNQVSLTCDVSGFFLYSKLTVDKSRWQQGNVFSCSVMHEAL
HNHYTQKSLSLSPGK (SEQ ID NO: 420)

Heavy chain 2 (mAb612_H0L0_scFv(GKPGS)4_Fc(216)_IgG1_C220S_S239D/I332E/S364K/E357Q)

EVQLLGSGGGLVQPGGSLRLSCAASGFTFTTYYMHWVRQAPGKGLEWVSLISPNAGNTYYADSVKGRFTISRDNSKNTLYLQMNSLRAEDTAVYYCARGRSRAGT
SGMDYWGQGTLVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTD
FTLTISRLEPEDFAVYYCQQAASPITFGQGTKVEIKEPKSSDKTHTCPPCPAPELLGGPDVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 421)

Light chain (mAb1567_L1.1)

DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC
(SEQ ID NO: 422)

FIGURE 51T

XENP016262 Anti-CCR4 x Anti-CCR6 FcKO bispecific (mAB1567_H1.1_L1.1 x mAb612_H0L0)

Heavy chain 1 (mAb1567_H1.1_IgG1_pI(-)_Isosteric_A_PVA_/S267K/L368D/K370S)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPPVAGPSVFLFPPKPKDTLMISRTPEVTCVVVDVSHEDPEVKFNWYVDGVEVHNAKTKPREEYNSTYRVVSVLTVLHQDWLNGKEYKCKVS
NKALPAPIEKTISKAKGQPREPQVYTLPPSREEMTKNQVSLTCLVKGFYPSDIAVEWESNGQPENNYKTTPPVLDSDGSFFLYSKLTVDKSRWEQGDVFSCSVMHEALH
NHYTQKSLSLSPGK (SEQ ID NO: 423)

Heavy chain 2 (mAb612_H0L0_scFv(GKPGS)4_Fc(216)_IgG1_C220S/PVA_/S267K/S364K/E357Q)

EVQLLGSGGGLVQPGGSLRLSCAASGFTFTTYYMHWVRQAPGKGLEWVSLISPNAGNTYYADSVKGRFTISRDNSKNTLYLQMNSLRAEDTAVYYCARGRSRAGT
SGMDYWGQGTLVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTD
FTLTISRLEPEDFAVYYCQQAASSPITFGQGTKVEIKEPKSSDKTHTCPPCPAPPVAGPSVFLFPPKPKDTLMISRTPEVTCVVVDVKHEDPEVKFNWYVDGVEHNAKT
KPREEQYNSTYRVVSVLTVLHQDWLNGKEYKCKVSNKALPAPIEKTISKAKGQPREPQVYTLPPSREQMTKNQVLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 424)

Light chain (mAb1567_L1.1)

DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC
(SEQ ID NO: 425)

FIGURE 51U

XENP016281 Anti-CD4 x Anti-CCR6 High ADCC bispecific (OKT4A_H1L1-mAb612_H0L0)

Heavy chain 1 (OKT4A_H1_IgG1_pI(-)_Isosteric_A_S239D/I332E/L368D/K370S)

EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYD
PFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPELLGGPDVFLFPPKPKDTLMISRTPEVTCVVVDVSHEDPEVKFNWYVDGVEVHNAKTPREEEYNSTYRVVSVLTVLHQDWLNGKEYKC
KVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGGDVFSCSVMHE
ALHNHYTQKSLSLSPGK (SEQ ID NO: 426)

Heavy chain 2 (mAb612_H0L0_scFv(GKPGS)4_Fc(216)_IgG1_C220S_S239D/I332E/S364K/E357Q)

EVQLLGSGGGLVQPGGSLRLSCAASGFTFTTYYMHWVRQAPGKGLEWVSLISPNAGNTYYADSVKGRFTISRDNSKNTLYLQMNSLRAEDTAVYYCARGRSRAGT
SGMDYWGQGTLVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTD
FTLTISRLEPEDFAVYYCQQAASPITFGQGTKVEIKEPKSSDKTHTCPPCPAPELLGGPDVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 427)

Light chain (OKT4A_L1)

DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID
NO: 428)

FIGURE 51V

XENP016479 Anti-GITR x Anti-CCR4 High ADCC bispecific (1D8_H0L0 x mAb1567_H1.1_L1.1)

Heavy chain 1 (1D8_H0_IgG1_pI(-)_Isosteric_A_S239D/I332E/L368D/K370S)

QVTLKESGPGILKPSQTLSLTCSFSGFSLSTSGMGVGWIRQPSGKGLEWLAHIWWDDDKYYSPSLKSQLTISKDTSRNQVFLKITSLDTADTATYYCVRSYYYGSSGA
MDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDK
KVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCK
VSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEA
LHNHYTQKSLSLSPGK (SEQ ID NO: 429)

Heavy chain 2 (mAb1567_H1.1_L1.1_scFv(GKPG)4_Fc(216)_IgG1_C220S_S239D/I332E/S364K/E357Q)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSG
TDFTLTISSLEAEDVAVYYCHQYLSSYTFGGGTKLEIKEPKSSDKTHTCPPCPAPELLGGPDVFLFPPKPKDTLMISRTPEVTCVVVDVSHEDPEVKFNWYVDGVEVHNAK
TKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO: 430)

Light chain (1D8_L0)

DIVMTQTPLSLPVSLGDQASISCRSSQSLVHSDGNTYLHWYLQKPGQSPKLLIYKVSNRFSGVPDRFSGSGSGTDFTLKISRVEAEDLGVYFCSQSTHVPPTFGGGTKL
EIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC
(SEQ ID NO: 431)

FIGURE 51W

XENP016482 Anti-GITR x Anti-CTLA4 High ADCC (1D8_H0L0 x ipilimumab)

Heavy chain 1 (1D8_H0_IgG1_pI(-)_Isosteric_A_S239D/I332E/L368D/K370S)

QVTLKESGPGILKPSQTLSLTCSFSGFSLSTSGMGVGWIRQPSGKGLEWLAHIWWDDDKYYSPSLKSQLTISLDTADTATYYCVRSYYYGSSGA
MDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDK
KVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCK
VSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEA
LHNHYTQKSLSLSPGK (SEQ ID NO: 432)

Heavy chain 2 (ipilimumab_H0L0_scFv(GKPGS)4_Fc(216)_IgG1_C220S_S239D/I332E/S364K/E357Q)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTI
SRLEPEDFAVYYCQQYGSSPWTFGQGTKVEIKEPKSSDKTHTCPPCPAPELLGGPDVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 433)

Light chain (1D8_L0)

DIVMTQTPLSLPVSLGDQASISCRSSQSLVHSDGNTYLHWYLQKPGQSPKLLIYKVSKRFSGVPDRFSGSGSGTDFTLKISRVEAEDLGVYFCSQSTHVPPTFGGGTKL
EIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC
(SEQ ID NO: 434)

FIGURE 51X

XENP016485 Anti-GITR x Anti-CCR4 FcKO bispecific (1D8_H0L0 x mAb1567_H1.1_L1.1)

Heavy chain 1 (1D8_H0_IgG1_pI(-)_Isosteric_A_PVA_/S267K/L368D/K370S)

QVTLKESGPGILKPSQTLSLTCSFSGFSLSTSGMGVGWIRQPSGKGLEWLAHIWWDDDKYYSPSLKSQLTISKDTSRNQVFLKITSLDTADTATYYCVRSYYYGSSGA
MDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDK
KVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKV
SNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK (SEQ ID NO: 435)

Heavy chain 2 (mAb1567_H1.1_scFv(GKPGS)4_Fc(216)_IgG1_C220S/PVA_/S267K/S364K/E357Q)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSG
TDFTLTISSLEAEDVAVYYCHQYLSSYTFGGGTKLEIKEPKSSDKTHTCPPCPAPPVAGPSVFLFPPKPKDTLMISRTPEVTCVVVDVKHEDPEVKFNWYVDGVEVHNAK
TKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 436)

scFV:
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSG
TDFTLTISSLEAEDVAVYYCHQYLSSYTFGGGTKLEIK (SEQ ID NO: 437)

Light chain (1D8_L0)

DIVMTQTPLSLPVSLGDQASISCRSSQSLVHSDGNTYLHWVLQKPGQSPKLLIYKVSKRFSGVPDRFSGSGSGTDFTLKISRVEAEDLGVYFCSQSTHVPPTFGGGTKL
EIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC
(SEQ ID NO: 438)

FIGURE 51Y

XENP016488 Anti-GITR x Anti-CTLA4 FcKO bispecific (1D8_H0L0 x ipilimumab)

Heavy chain 1 (1D8_H0_IgG1_pI(-)_Isosteric_A_PVA_/S267K/L368D/K370S)

QVTLKESGPGILKPSQTLSLTCSFSGFSLSTSGMGVGWIRQPSGKGLEWLAHIWWDDDKYYSPSLKSQLTISKDTSRNQVFLKITSLDTADTATYYCVRSYYYGSSGA
MDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDK
KVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKV
SNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK (SEQ ID NO: 439)

Heavy chain 2 (ipilimumab_H0L0_scFv(GKPGS)4_Fc(216)_IgG1_C220S/PVA_/S267K/S364K/E357Q)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTI
SRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSD
GSFFLYSKLTVDKSRWQQGNVFSCSVMHEALHNHYTQKSLSLSPGK (SEQ ID NO: 440)

Light chain (1D8_L0)

DIVMTQTPLSLPVSLGDQASISCRSSQSLVHSDGNTYLHWYLQKPGQSPKLLIYKVSKRFSGVPDRFSGSGSGTDFTLKISRVEAEDLGVYFCSQSTHVPPTFGGGTKL
EIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC
(SEQ ID NO: 441)

FIGURE 51Z

XENP016480 Anti-OX40 x Anti-CCR4 High ADCC bispecific (11D4_H0L0 x mAb1567_H1.1_L1.1)

Heavy chain 1 (11D4_H0_IgG1_pI(-)_Isosteric_A_S239D/I332E/L368D/K370S)

EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFD YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV EPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVS NKALPAPEEKTISKAKGQPREPQVYTLPPSREEMTKNQVSLTCDVSGFYPSDIAVEWESDGQPENNYKTTPPVLDSDGSFFLYSKLTVDKSRWQEQGVFSCSVMHEALH NHYTQKSLSLSPGK (SEQ ID NO: 442)

Heavy chain 2 (mAb1567_H1.1_L1.1_scFv(GKPGS)4_Fc(216)_IgG1_C220S_S239D/I332E/S364K/E357Q)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL DYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSG TDFTLTISSLEAEDVAVYYCHQYLSSYTFGGGTKLEIKEPKSSDKTHTCPPCPAPELLGGPDVFLFPPKPKDTLMISRTPEVTCVVVDVSHEDPEVKFNWYVDGVEVHNAK TKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPV LDSDGSFFLYSKLTVDKSRWQQGNVFSCSVMHEALHNHYTQKSLSLSPGK (SEQ ID NO: 443)

scFv:

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL DYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSG TDFTLTISSLEAEDVAVYYCHQYLSSYTFGGGTKLEIK (SEQ ID NO: 444)

Light chain (11D4_L0)

DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKRT VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 445)

FIGURE 51AA

XENP016483 Anti-OX40 x Anti-CTLA4 High ADCC bispecific (11D4_H0L0 x ipilimumab)

Heavy chain 1 (11D4_H0_IgG1_pI(-)_Isosteric_A_S239D/I332D/L368D/K370S)

EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFD
<u>YWGQGTLVTVSS</u>ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV
EPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVS
NKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK (SEQ ID NO: 446)

Heavy chain 2 (ipilimumab_H0L0_scFv(GKPGS)4_Fc(216)_IgG1_C220S_S239D/I332E/S364K/E357Q)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
<u>DYWGQGTLVTVSS</u>GKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTI
<u>SRLEPEDFAVYYCQQ</u>YGSSPWTFGQGTKVEIKEPKSSDKTHTCPPCPAPELLGGPDVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 447)

Light chain (11D4_L0)

DIQMTQSPSSLSASVGDRVTITCRASQGISS<u>WLA</u>WYQQKPEKAPKSLIYAASSLQSGVPSRFSGSGSGTDFTLTISSLQPEDFATYYCQQYNSYPPTFGGGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 448)

FIGURE 51BB

XENP016486 Anti-OX40 x Anti-CCR4 FcKO bispecific (11D4_H0L0 x mAb1567_H1.1_L1.1)

Heavy chain 1 (11D4_H0_IgG1_pI(-)_isosteric_A_PVA_/S267K/L368D/K370S)

EVQLVESGGGLVQPGGSLRLSCAASGFTFSSYSMNWVRQAPGKGLEWVSYISSSSTIDYADSVKGRFTISRDNAKNSLYLQMNSLRDEDTAVYYCARESGWYLFD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV
EPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSDGSFFLYSKLTVDKSRWEQGDVFSCSVMHEALHN
HYTQKSLSLSPGK (SEQ ID NO: 449)

Heavy chain 2 (mAb1567_H1.1_L1.1_scFv(GKPGS)4_Fc(216)_IgG1_C220S/PVA_/S267K/S364K/E357Q)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYRPL
DYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSG
TDFTLTISSLEAEDVAVYYCHQYLSSYTFGGGTKLEIKEPKSSDKTHTCPPCPAPPVAGPSVFLFPPKPKDTLMISRTPEVTCVVVDVKHEDPEVKFNWYVDGVEVHNAK
TKPREEQYNSTYRVVSVLTVLHQDWLNGKEYCKCKVSNKALPAPIEKTISKAKGQPREPQVTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 450)

Light chain (11D4_L0)

DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ
ID NO: 451)

FIGURE 51CC

XENP016489 Anti-OX40 x Anti-CTLA4 FcKO bispecific (11D4_H0L0 x ipilimumab)

Heavy chain 1 (11D4_H0_IgG1_pI(-)_Isosteric_A_PVA_/S267K/L368D/K370S)

EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFD
YWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV
EPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCLVKGFYPSDIAVEWESDGQPENNYKTTPPVLDSDGSFFLYSKLTVDKSRWQEGNVFSCSVMHEALHN
HYTQKSLSLSPGK (SEQ ID NO: 452)

Heavy chain 2 (ipilimumab_H0L0_scFv(GKPG5)4_Fc(216)_IgG1_C220S/PVA_/S267K/S364K/E357Q)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSGKPGSGKPGSGKPGSGKPGSEIMLTQSPGTLSLSPGERATLSCRASQSVGSSYLAWYQQKPGQAPRLLIYGAFSRATGIPDRFSGSGSGTDFTLTI
SRLEPEDFAVYYCQQYSSPWTFGQGTKVEIKEPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSD
GSFFLYSKLTVDKSRWQQGNVFSCSVMHEALHNHYTQKSLSLSPGK (SEQ ID NO: 453)

Light chain (11D4_L0)

DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 454)

FIGURE 51DD

XENP015841 Anti-CTLA4 x Anti-CCR4 High ADCC bispecific (ipilimumab x mAb1567_H1.1_L1.1)

Heavy chain 1 (ipilimumab_H0_IgG1_pI(-)_Isosteric_A_S239D/I332E/L368D/K370S)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSREEMTKNQVSLTCLVKGFYPSDIAVEWESNGQPENNYKTTPPVLDSDGSFFLYSKLTVDKSRWQEGDVFSCSVMHEAL
HNHYTQKSLSLSPGK (SEQ ID NO: 455)

Heavy chain 2 (mAb1567_H1.1_L1.1_scFv(GKPGS)4_Fc(216)_IgG1_C220S_S239D/I332E/S364K/E357Q)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSGKPGSGKPGSGKPGSGKPGSDIELTQSPDSLAVSLGERATINCKSSQSILVSSNQKNYLAWYQQKPGQSPKLLIYWASTRESGVPDRFTGSGSG
TDFTLTISSLEAEDVAVYYCHQYLSSYTFGGGTKLEIKEPKSSDKTHTCPPCPAPELLGGPDVFLFPPKPKDTLMISRTPEVTCVVVDVSHEDPEVKFNWYVDGVEVHNAK
TKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO: 456)

Light chain (ipilimumab_L0)

EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 457)

FIGURE 51EE

XENP015843 Anti-CTLA4 x Anti-CCR4 FcKO bispecific (ipilimumab x mAb1567_H1.1_L1)

Heavy chain 1 (ipilimumab_H0_IgG1_pI(-)_Isosteric_A_PVA_/S267K/L368D/K370S)

QVQLVESGGGVVQPGRSRLRLSCAASGFTFSSYTMHWVRQAPGKGLEWVTFISYDGNNKYYADSVKGRFTISRDNSKNTLYLQMNSLRAEDTAIYYCARTGWLGPF
<u>DYWGQGTLVTVSS</u>ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK (SEQ ID NO: 458)

Heavy chain 2 (mAb1567_H1.1_L1.1_scFv(GKPGS)4_Fc(216)_IgG1_C220S/PVA_/S267K/S364K/E357Q)

EVQLVQSGAEVKKPGASVKVSCKASGYTFASYYIQWMRQGQGLEWMGWINPGNVNTKYNEKFQGRVTITADKSITTAYMELSSLRSEDTAVYFCARSTYYRPL
<u>DYWGQGTTVTVSS</u>GKPGSGKPGSGKPGSGKPGS<u>DIELTQSPDSLAVSLGERATINCKSSQSILYSSNQKNYLAWYQQKPGQSPKLLIYWASTRESGVPDRFTGSGSG
TDFTLTISSLEAEDVAVYYCHQYLSSYTFGGGTKLEIK</u>EPKSSDKTHTCPPCPAPPVAGPSVFLFPPKPKDTLMISRTPEVTCVVVDVSKHEDPEVKFNWYVDGVEVHNAK
TKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 459)

Light chain (ipilimumab_L0)

EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 460)

FIGURE 51FF

XENP016267 Anti-CCR4 x Anti-CTLA4 High ADCC (mAb1567_H1.1_L1.1 x ipilimumab)

Heavy chain 1 (mAb1567_H1.1_IgG1_pI(-)_Isosteric_A_S239D/I332E/L368D/K370S)

**EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSS**ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEAL
HNHYTQKSLSLSPGK (SEQ ID NO: 461)

Heavy chain 2 (ipilimumab_H0L0_scFv(GKPGS)4_Fc(216)_IgG1_C220S_S239D/I332E/S364K/E357Q)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTI
SRLEPEDFAVYYCQQYGSSPMTFGQGTKVEIKEPKSSDKTHTCPPCPAPELLGGPDVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK (SEQ ID NO: 462)

Light chain (mAb1567_L1.1)

DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 463)

FIGURE 51GG

XENP016268 Anti-CCR4 x Anti-CTLA4 FcKO bispecific (mAb1567_H1.1_L1.1 x ipilimumab)

Heavy chain 1 (mAb1567_H1.1_IgG1_pI(-)_Isosteric_A_PVA_/S267K/L368D/K370S)

EVQLVQSGAEVKKPGASVKVSCKASGYTFASYIQWMRQAPGQGLEWMGWINPGNVNTKYNEKFQGRVTITADKSITTAYMELSSLRSEDTAVYFCARSTYYRPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK (SEQ ID NO: 464)

Heavy chain 2 (ipilimumab_H0L0_scFv(GKPGS)4_Fc(216)_IgG1_C220S/PVA_/S267K/S364K/E357Q)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTI
SRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSD
GSFFLYSKLTVDKSRWQQGNVFSCSVMHEALHNHYTQKSLSLSPGK (SEQ ID NO: 465)

Light chain (mAb1567_L1.1)

DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 466)

FIGURE 51HH

XENP016280 Anti-CD4 x Anti CD25 High ADCC bispecific (OKT4A_H1L1 x Anti-TAC_H1.6_L1.71)

Heavy chain 1 (OKT4A_H1_IgG1_pI(-)_isosteric_A_S239D/I332E/L368D/K370S)

EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYD
PFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKC
KVSNKALPAPEEKTISKAKGQPREPQVYTLPPSREEMTKNQVSLTCDVSGFYPSDIAVEWESDGQPENNYKTTPPVLDSDGSFFLYSKLTVDKSRWQEQGDVFSCSVMHE
ALHNHYTQKSLSLSPGK (SEQ ID NO: 467)

Heavy chain 2 (Anti-TAC_H1.6_L1.71_scFv(GKPGS)4_Fc(216)_IgG1_C220S_S239D/I332E/S364K/E357Q)

QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGKPGSQIVLTQSPATLSLSPGERATLSCRASSSISYMHWFQQKPGQSPQLLIYDASNLASGVPARFSGSGSGTDYTLTISSL
QPEDFAVYYCHQRSTYPLITFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 468)

Light chain (OKT4A_L1)

DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 469)

FIGURE 5III

XENP016481 Anti-LAG3 x Anti-CCR4 High ADCC bispecific (25F7_H0L0 x mAB1567_H1.1_L1.1)

Heavy chain 1 (25F7_H0_IgG1_pI(-)_Isosteric_A_S239D/I332E/L368D/K370S)

QVQLQQWGAGLLKPSETLSLTCAVYGGSFSDYYWNWIRQPPGKGLEWIGEINHNGNTNSNPSLKSRVTLSLDTSKNQFSLKLRSVTAADTAVYYCAFGYSDYEYN
WFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKC
KVSNKALPAPEEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMHE
ALHNHYTQKSLSLSPGK (SEQ ID NO: 470)

Heavy chain 2 (mAb1567_H1.1_L1.1_scFv(GKPGS)4_Fc(216)_IgG1_C220S_S239D/I332E/S364K/E357Q)

EVQLVQSGAEVKKPGASVKVSCKASGYTFASYYIIQWMRQAPGQGLEWMGWINPGNVNTKYNEKFQGRVTITADKSITTAYMELSSLRSEDTAVYFCARSTYYRPL
DYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSG
TDFTLTISSLEAEDVAVYYCHQYLSSYTFGGGTKLEIKEPKSSDKTHTCPPCPAPELLGGPDVFLFPPKPKDTLMISRTPEVTCVVVDVSHEDPEVKFNWYVDGVEVHNAK
TKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO: 471)

Light chain (25F7_L0)

EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID
NO: 472)

FIGURE 51JJ

XENP016487 Anti-LAG3 x Anti-CCR4 FcKO bispecific (25F7_H0L0 x mAB1567_H1.1_L1.1)

Heavy chain 1 (25F7_H0_IgG1_pi(-)_Isosteric_A_PVA_/S267K/L368D/K370S)

QVQLQQWGAGLLKPSETLSLTCAVYGGSFSDYYWNWIRQPPGKGLEWIGEINHNGNTNSNPSLKSRVTLSLDTSKNQFSLKLRSVTAADTAVYYCAFGYSDYEYN
WFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCK
VSNKALPAPIEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMHEAL
HNHYTQKSLSLSPGK (SEQ ID NO: 473)

Heavy chain 2 (mAb1567_H1.1_L1.1_scFv(GKPGS)4_Fc(216)_IgG1_C220S/PVA_/S267K/S364K/E357Q)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSGKPGSSGKPGSGKPGSSGKPGSDIELTQSPDSLAVSLGERATINCKSSQSILYSSNQKNYLAWYQQKPGQSPKLLIYWASTRESGVPDRFTGSSG
TDFTLTISSLEAEDVAVYYCHQYLSSYTFGGGTKLEIKEPKSSDKTHTCPPCPAPPVAGPSVFLFPPKPKDTLMISRTPEVTCVVVDVKHEDPEVKFNWYVDGVEVHNAK
TKPREEQYNSTYRVVSVLTVLHQDWLNGKEYKCKVSNKALPAPIEKTISKAKGQPREPQVTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 474)

Light chain (25F7_L0)

EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 475)

FIGURE 51KK

Anti-CTLA4 x Anti-CCR4 IgG1 bispecific

Tremelimumab_H0L0 x mAb1567_H1.112_L1.26 scFv IgG1 bispecific

Heavy chain 1 (Tremelimumab_H0_IgG1_pI(-)_Isosteric_A_/L368D/K370S

QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGA
TLYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHK
PSDTKVDKKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWL
NGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 476)

Heavy chain 2 (mAb1567_H1.112_L1.26_scFv(GKPGS)4_Fc(216)_IgG1_C220S_/S364K/E357Q EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPL
DYWGQGTTVTVSSGKPGSGKPGSGKPGSGKPGSDIELTQSPDSLAVSLGERATINCKSSQSILYSKNQKNYLAWYQQKPGQSPKLLIYWASTRESGVPDRFTGSGSG
TDFTLTISSLEAEDVAVYYCHQYLSSYTFGGGTKLEIKEPKSSDKTHTCPPCPAPELLGGPSVFLFPPKPKDTLMISRTPEVTCVVVDVSHEDPEVKFNWYVDGVEVHNAK
TKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 477)

Light chain (Tremelimumab_L0)

DIQMTQSPSSLSASVGDRVTITCRASQSINSYLDWYQQKPGKAPKLLIYAASSLQSGVPSRFSGSGSGTDFTLTISSLQPEDFATYYCQQYSTPFTFGPGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 478)

FIGURE 51LL

Anti-CCR4 x Anti-CD25 IgG1 bispecific mAb1567_H1.112_L1.26 x Anti-TAC_H1_L1.11 scFv IgG1 bispecific Heavy chain 1 (mAb1567_H1.112_IgG1_pI(-)_isosteric_A_/L368D/K370S)

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK (SEQ ID NO: 479)

Heavy chain 2 (Anti-TAC_H1_L1.11_scFv(GKPGS)4_Fc(216)_IgG1_C220S_/S364K/E357Q)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGKPGSQIVLTQSPATLSLSPGERATLSCRASSSISYMHWFQQKPGQSPQLLIYDTSNLASGVPARFSGSGSGTDYTLTISSL
QPEDFAVYYCHQRSTYPLTFGSGTKLEIKEPKSSDKTHTCPPCPAPELLGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREPQVYTLCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 480)

Light chain (mAb1567_L1.26)

DIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 481)

FIGURE 51MM

Anti-CTLA4 x Anti-CD25 IgG1 bispecific ipilimumab x Anti-TAC_H1.6_L1.71 scFv IgG1 bispecific Heavy chain 1 (ipilimumab_H0_IgG1_pI(-)_Isosteric_A_/L368D/K370S)

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPSVFLFPPKPKDTLMISRTPEVTCVVVDVSHEDPEVKFNWYVDGVEVHNAKTKPREEYNSTYRVVSVLTVLHQDWLNGKEYKCKV
SNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK (SEQ ID NO: 482)

Heavy chain 2 (Anti-TAC_H1.6_L1.71_scFv(GKPGS)4_Fc(216)_IgG1_C220S_/S364K/E357Q)

QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGQIVLTQSPATLSLSPGERATLSCRASSSISYMHWFQQKPGQSPQLLIYDASNLASGVPARFSGSGSGTDYTLTISSL
QPEDFAVYYCHQRSTYPLTFGSGTKLEIKEPKSSDKTHTCPPCPAPELLGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 483)

Light chain (ipilimumab_L0)

EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 484)

FIGURE 51NN

Anti-CD4 x Anti-CD25 IgG1 bispecific

OKT4A_H1.1_L1_x Anti-TAC_H1_L1.11 scFv IgG1 bispecific

Heavy chain 1 (OKT4A_H1.1_IgG1_pI(-)_Isosteric_A_/L368D/K370S)

EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGAYD
PFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKC
KVSNKALPAPIEKTISKAKGQPREPQVYTLPPSREEMTKNQVSLTCDVSGFYPSDIAVEWESDGQPENNYKTTPPVLDSDGSFFLYSKLTVDKSRWQQGDVFSCSVMHEA
LHNHYTQKSLSLSPGK (SEQ ID NO: 485)

Heavy chain 2 (Anti-TAC_H1_L1.11_scFv(GKPGS)4_Fc(216)_IgG1_C220S_/S364K/E357Q)

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGGKPGSGKPGSGKPGSGKPGSQIVLTQSPATLSLSPGERATLSCRASSSISYMHWFQQKPGQSPQLLIYDTSNLASGVPARFSGSGSGTDYTLTISSL
QPEDFAVYYCHQRSTYPLTFGSGTKLEIKEPKSSDKTHTCPPCPAPELLGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFL
YSKLTVDKSRWQQGNVFSCSVMHEALHNHYTQKSLSLSPGK (SEQ ID NO: 486)

Light chain (OKT4A_L1)

DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 487)

FIGURE 5100

XENP15203 (OKT4A_H1.1_L1 x Anti-TAC_H1L1_scFv High ADCC S239D/I332E bispecific)

OKT4A_H1.1_L1 Heavy chain

EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGAYD
PFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVD
KKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKC
KVSNKALPAPEEKTISKAKGQPREPQVYTLPPSREEMTKNQVSLTCDVSGFYPSDIAVEWESDGQPENNYKTTPPVLDSDGSFFLYSKLTVDKSRWQQGNVFSCSVMHE
ALHNHYTQKSLSLSPGK (SEQ ID NO: 488)

Anti-TAC_H1L1 scFv Heavy chain

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSSGKPGSSGKPGSSGKPGSGSQIVLTQSPATLSLSPGERATLSCRASSSISYMHWFQQKPGQSPQLLIYTTSNLASGVPARFSGSGSGTDYTLTISSL
QPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 489)

OKT4A_H1.1_L1 Light chain

DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 490)

FIGURE 51PP

XENP15183 (OKT4 H1L1 x Anti-TAC H1L1 scFv High ADCC S239D/I332E bispecific)

OKT4 H1L1 Heavy chain

**QIQLVQSGSELKKPGASVKVSCKASGYTFTNYGMNWVRQAPGQGLEWMGWINTNTGEPTYAEGFTGRFVFSLDTSVTTAYLQISSLKAEDTAVYFCARLGIYYDY
GYYAMDYWGQGTTVTVSS**ASTKGPSVFPLAPSSKSTSGGTAALGCLVKDYFPEPVTVSWNSGALTSGVHTFPAVLQSSGLYSLSSVVTVPSSSLGTQTYICNVNHKPSD
TKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGK
EYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSV
MHEALHNHYTQKSLSLSPGK (SEQ ID NO: 491)

Anti-TAC H1L1 scFv Heavy chain

**QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YW**GQGTLVTVSSGKPGSGKPGSGKPGSGKPGSGQIVLTQSPATLSLSPGERATLSCRASSSISYMHWFQQKPGQSPQLLIYTTSNLASGVPARFSGSGSGTDYTLTISSLQP
EDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQYNST
YRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYS
KLTVDKSRWQQGNVFSCSVMHEALHNHYTQKSLSLSPGK (SEQ ID NO: 492)

OKT4 H1L1 Light chain

NIVLTQSPATLSLSPGERATLSCRASESVDSYGNSFMHWYQQKPGQPPRLLIYLASNLESGVPARFSGSGSRTDFTLTISSLEPEDFAVYYCQQNNEDPYTFGGGTKLEI
KRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 493)

FIGURE 51QQ

XENP15186 (OKT4 H1L1 x Anti-TAC H1.6_L1.1 scFv High ADCC S239D/I332E bispecific)

OKT4 H1L1 Heavy chain

QIQLVQSGSELKKPGASVKVSCKASGYTFTNYGMNWVRQAPGQGLEWMGWINTNTGEPTYAEGFTGRFVFSLDTSVTTAYLQISSLKAEDTAVYFCARLGIYYDY
GYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSD
TKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGK
EYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWQEGDVFSCSV
MHEALHNHYTQKSLSLSPGK (SEQ ID NO: 494)

Anti-TAC H1.6_L1.1 scFv Heavy chain

QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFD
YWGQGTLVTVSSGKPGSSGKPGSSGKPGSGKPGSGVLTQSPATLSLSPGERATLSCRASSSISYMHWFQQKPGQSPQLLIYTTSNLASGVPARFSGSGSGTDYTLTISSL
QPEDFAVYYCQQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 495)

OKT4 H1L1 Light chain

NIVLTQSPATLSLSPGERATLSCRASESVDSYGNSFMHWYQQKPGQPPRLLIYLASNLESGVPARFSGSGSRTDFTLTISSLEPEDFAVYYCQQNNEDPYTFGGGTKLEI
KRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 496)

FIGURE 51RR

XENP15187 (mAb1567 H1.1_L1.1x Anti-TAC H1_L1 scFv High ADCC S239D/I332E bispecific)

mAb1567 H1.1_L1.1 Heavy chain

EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPL
DYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEYNSTYRVVSVLTVLHQDWLNGKEYKCKV
SNKALPAPEEKTISKAKGQPREPQVYTLPPSREEMTKNQVSLTCDVSGFYPSDIAVEWESDGQPENNYKTTPPVLDSDGSFFLYSKLTVDKSRWQQGNVFSCSVMHEAL
HNHYTQKSLSLSPGK (SEQ ID NO: 497)

Anti-TAC H1_L1 scFv Heavy chain

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGKPGSQIVLTQSPATLSLSPGERATLSCRASSSISYMHWFQQKPGQSPQLLIYTTSNLASGVPARFSGSGSGTDYTLTISSL
QPEDFAVYYCHQRSTYPLITFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 498)

mAb1567 H1.1_L1.1 Light chain

DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLE
IKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 499)

FIGURE 51SS

XENP15191 (ipilimumab HOLO x Anti-TAC H1L1 scFv High ADCC S239D/I332E bispecific)

Ipilimumab HOLO Heavy chain

QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPF
DYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKK
VEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKV
SNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEAL
HNHYTQKSLSLSPGK (SEQ ID NO: 500)

Anti-TAC H1_L1 scFv Heavy chain

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGKPGSQIVLTQSPATLSLSPGERATLSCRASSSISYMHWFQQKPGQSPQLLIYTTSNLASGVPARFSGSGSGTDYTLTISSL
QPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 501)

Ipilimumab HOLO light chain

EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRT
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 502)

FIGURE 51TT

XENP15195 (nivolumab H0L0 x Anti-TAC H1_L1 scFv High ADCC S239D/I332E bispecific)

Nivolumab H0L0 Heavy chain

QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYW
GQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKA
LPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHY
TQKSLSLSPGK (SEQ ID NO: 503)

Anti-TAC_H1_L1 scFv Heavy chain

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSGKPGSGKPGSGQIVLTQSPATLSLSPGERATLSCRASSSISYMHWFQQKPGQSPQLLIYTTSNLASGVPARFSGSGSGTDYTLTISSL
QPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 504)

Nivolumab H0L0 Light chain

EIVMLTQSPATLSLSPGERATLSCRASQSVSSYLAWYQQKPGQAPRLLIYDASNRATGIPARFSGSGSGTDFTLTISSLEPEDFAVVYYCQQSSNWPRTFGQGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 505)

FIGURE 51UU

XENP15201 (nivolumab H0L0 x Anti-TAC H1_L1.11 scFv High ADCC S239D/I332E bispecific)

Nivolumab H0L0 Heavy chain

QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYW
GQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKA
LPAPEEKTISKAKGQPREPQVYTLPPSREEMTKNQVSLTCLVKGFYPSDIAVEWESDGQPENNYKTTPPVLDSDGSFFLYSKLTVDKSRWQEGNVFSCSVMHEALHNHY
TQKSLSLSPGK (SEQ ID NO: 506)

Anti-TAC H1_L1.11 scFv Heavy chain

QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFD
YWGQGTLVTVSSGKPGSSGKPGSSGKPGSSGIVLTQSPATLSLSPGERATLSCRASSSISYMHWFQQKPGQSPQLLIYDTSNLASGVPARFSGSGSGTDYTLTISSL
QPEDFAVYYCHQRSTYPLITFGSGTKLEIKEPKSSDKTHTCPPCPAPELLGGPDVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFF
LYSKLTVDKSRWQQGNVFSCSVMHEALHNHYTQKSLSLSPGK (SEQ ID NO: 507)

Nivolumab H0L0 Light chain

EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 508)

FIGURE 58
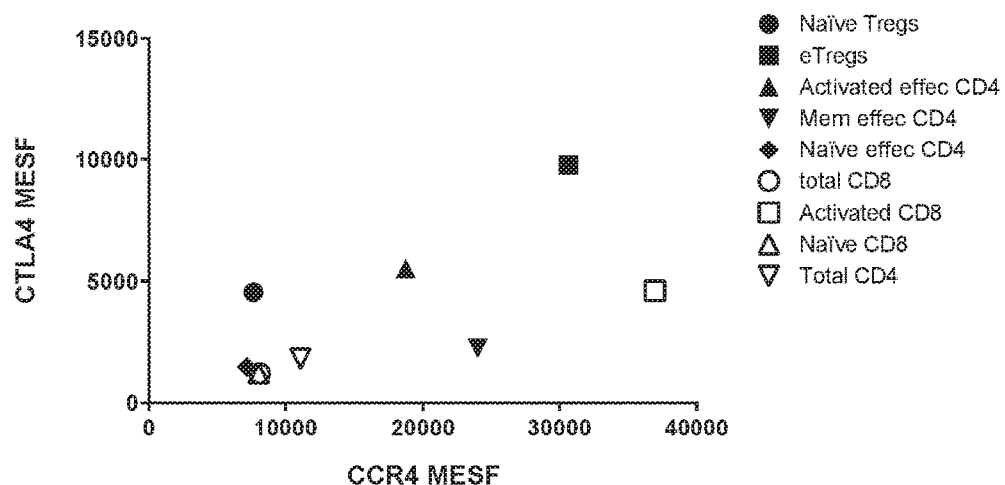
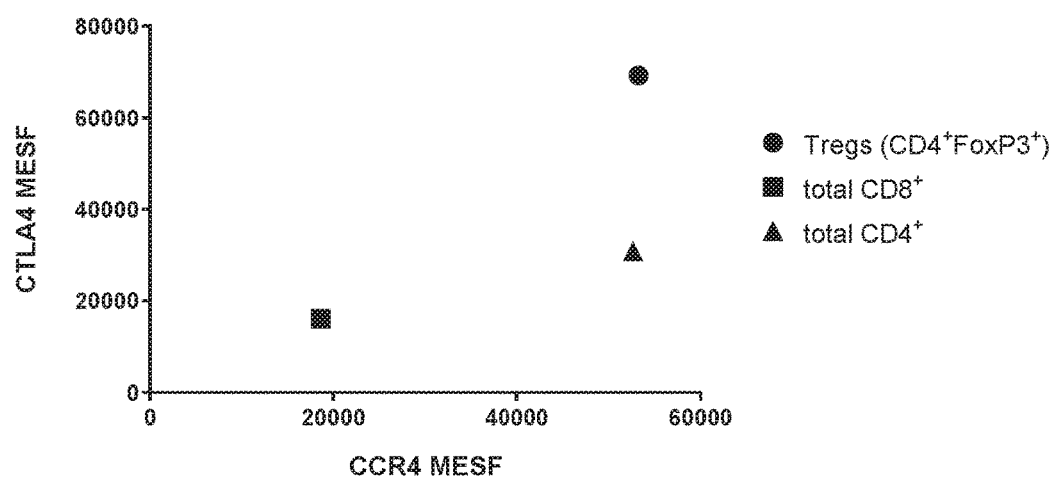

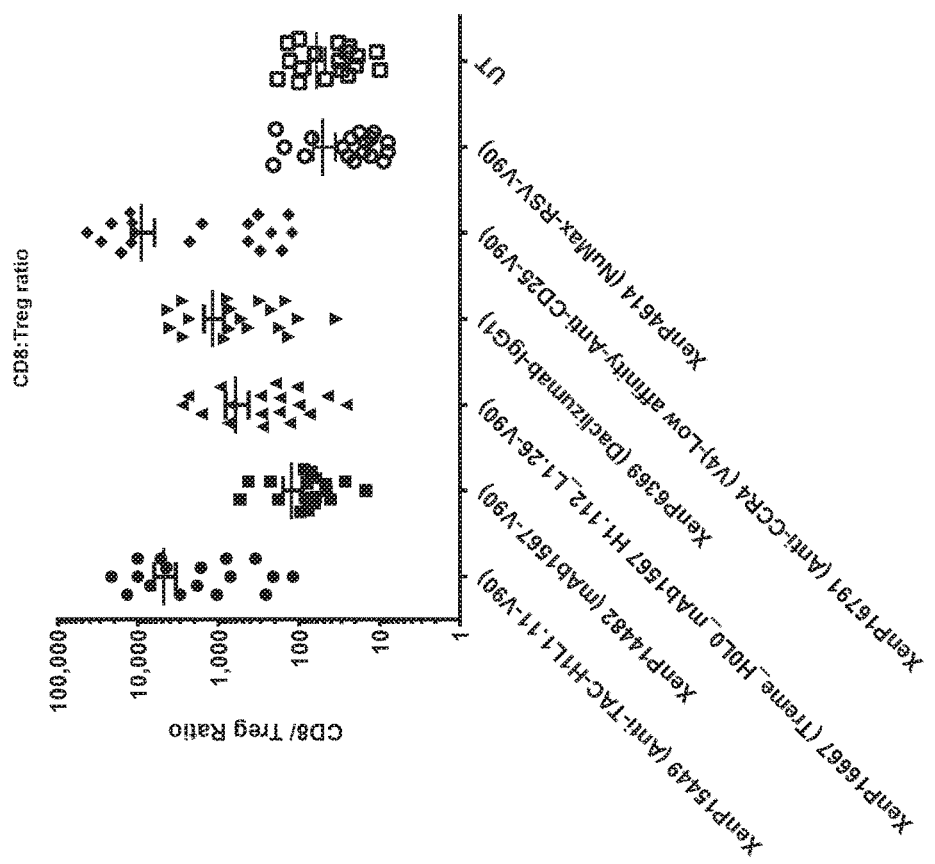

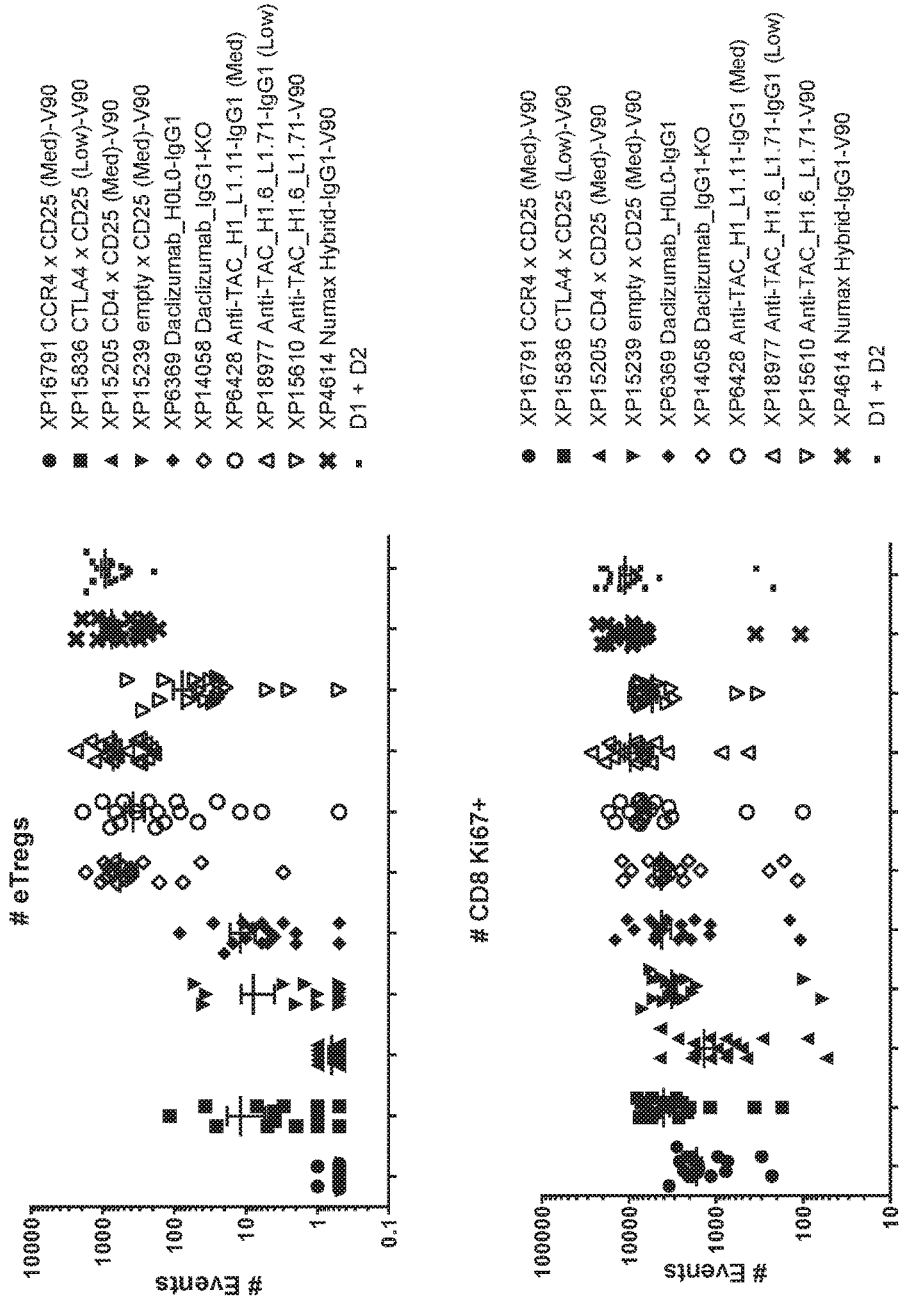

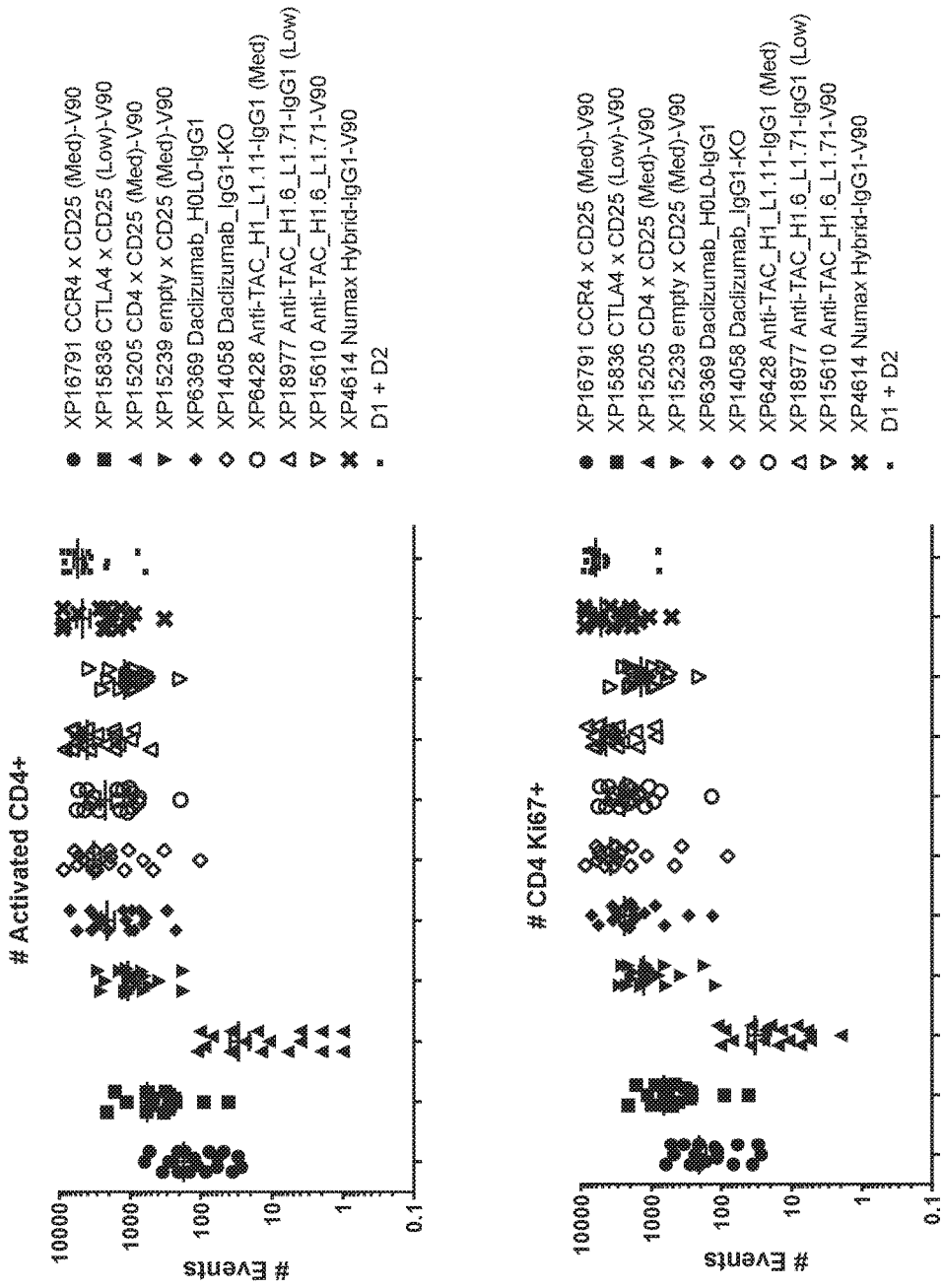

MODULATION OF T CELLS WITH BISPECIFIC ANTIBODIES AND FC FUSIONS

PRIORITY CLAIM

This application claims priority to U.S. Provisional Application Ser. No. 62/128,843, filed Mar. 5, 2015, which is expressly incorporated by reference in the entirety.

RELATED APPLICATIONS

U.S. Ser. No. 14/217,166, filed Mar. 14, 2014; Ser. No. 14/216,705, filed Mar. 17, 2014; and U.S. Pat. No. 8,314,213 are all expressly incorporated by reference in their entirety, particularly for the recitation of heterodimeric antibodies having a "bottle opener"/"triple F" configuration, sequences and CDRs for anti-CD25 antigen binding sites, amino acid positions and substitutions, and all data, figures and legends relating thereto.

TECHNICAL FIELD

The present disclosure relates to methods and compositions for modulating T cells.

BACKGROUND OF THE INVENTION

Immune system homeostasis relies on a fine balance between a variety of T cell populations, including effector CD8 and CD4 T cells and regulatory T cells. In disease states however, such as cancer and autoimmune disease, this balance can be perturbed. In cancer, infiltrating anti-tumor cytotoxic T cells can be prevented from attacking cancer cells by tumor-resident regulatory T cells. This can be seen from analysis of most human tumors, in which there is a significant correlation between immune infiltration by cytotoxic T cells and improved outcome, whereas infiltration by regulatory T cells is instead associated with a poor outcome. Indeed, several studies have demonstrated prognostic significance of the CD8/Treg tumor ratio. Numerous mouse models have shown that depletion of Treg with anti-CD25 antibody before tumor implantation can have a dramatic impact on prevention of tumor growth. In autoimmune diseases, effector T cells remain unregulated and attack the body's own tissues. A major premise in this regard is that defects in Treg cell number or function are a contributing factor. Therefore, the ability to alter the balance between cytotoxicity and regulation by fine-tuning the T cell response has great potential for the treatment of cancer, autoimmune, and other diseases.

One approach to controlling the balance of effector to regulatory T cells is to target the Treg population for direct modulation. However, despite years of effort, the discovery of a single Treg-specific surface marker has been elusive, frustrating efforts to deplete them specifically with monoclonal antibodies.

Effector versus regulatory T cells can be loosely identified by their surface markers, which can change based on their activation state. Cytotoxic T cells express CD8, which interacts with class I MHC. Effector helper T cells express CD4, which interacts with class II MHC on antigen-presenting cells. The hallmark of Treg cells is constitutive expression of both CD4 and CD25. CD25 is the alpha component of the IL2 receptor (IL2Rα), which, together with CD122 (IL2Rβ) and the common cytokine receptor γ-chain($y_c$) (CD132) form the trimeric high-affinity receptor for IL2. Several approaches have attempted Treg-specific depletion by targeting the high-affinity IL2 receptor CD25 (IL2Rα) with anti-CD25 antibodies such as daclizumab, or with IL2-diptheria toxin (IL2-DT) fusions. However, CD25 alone is not an ideal target because it also expressed on CD8 and CD4 effector T cells upon activation. In fact, many Treg surface markers are also expressed on effector T cells or other cell types. Targeting Treg cells with a conventional antibody to one of the Treg surface markers will likely lead to simultaneous binding to effector T cells or other cell types sharing the same surface markers. Thus, approaches that target Treg CD25 by itself might defeat their own purpose by also depleting the activated effector cells that could potentially attack the tumor.

Because of the importance of IL2 for T cell proliferation and homeostasis, a variety of approaches to T cell modulation have utilized IL2 itself or blocking of its high-affinity receptor component CD25. Systemic IL2 administration (Proleukin) is an approved therapy for metastatic melanoma and metastatic renal cell carcinoma based on its ability to promote expansion of effector T cells. However, systemic IL2 administration is also expected to promote the suppressive Treg population, potentially diminishing or confounding the desired enhancement of cytotoxic T cells. Furthermore, systemic IL2 administration is also associated with a variety of toxicities. Patients receiving systemic IL2 treatment frequently experience severe cardiovascular, pulmonary, renal, hepatic, gastrointestinal, neurological, cutaneous, haematological and systemic adverse events. The majority of these side effects can be explained by the development of so-called vascular leak syndrome (VLS), a pathological increase in vascular permeability leading to pulmonary edema and other issues. There is no treatment of VLS other than withdrawal of IL2. These problems have led to the pursuit of IL2 variants that perturb its affinity for one or more of its receptor subunits. Alternatively, anti-CD25 antibodies that block IL2-mediated T cell expansion have been utilized to treat various diseases. Zenapax (daclizumab) is an approved immunosuppressant for organ transplantation and is being investigated for the treatment of autoimmune diseases such as multiple sclerosis. These uses were developed based on daclizumab's presumed ability to reduce effector T cell responses. However, due to the more recently recognized dependence of Treg on IL2 for survival, daclizumab is now—somewhat paradoxically—being utilized in efforts to reduce Treg numbers in oncology. Because of the strong potential of either IL2 or anti-CD25 agents to promote or reduce both effector T cells and Treg with limited selectivity, there is a strong need in the field to create more selective Treg modulators.

SUMMARY OF THE INVENTION

Accordingly, provided herein are methods and compositions for suppressing and inducing T cells (e.g., regulatory T cells (Tregs)). In preferred aspects, the methods and compositions of the invention suppress or induce specific T cell types (e.g., Tregs) with little or no impact on other T cell types. Targeting Treg cells with a conventional antibody to one of the Treg surface markers will likely lead to simultaneous binding to effector T cells or other cell types sharing the same surface markers. By using a bispecific antibody however, it is possible to use avidity to target two separate Treg surface markers and avoid unwanted binding to effector T cells and other cell types. Targeting two (e.g. CD4×CD25, CCR4×CD25, CTLA4×CD25, CCR4×CTLA4, etc.) antigens with a bispecific antibody could be a powerful mechanism for suppressing and inducing such Treg populations.

Such antibodies are useful, for example, for suppressing Treg cells and allow the immune system to mount a response against tumor cells.

In some embodiments, the methods and compositions of the invention suppress or induce regulatory T cells with little or no impact on other T cell types, including cytotoxic T cells. In other embodiments, the methods and compositions of the invention suppress or induce cytotoxic T cells with little or no impact on other T cell types, including regulatory T cells.

In one aspect, provided herein are heterodimeric antibodies that include a first mononomer and a second monomer. The first monomer includes a first IgG Fc domain; and a first antigen binding domain that binds a first regulatory T cell (Treg) marker, the first antigen binding domain includes a heavy chain variable domain and a light chain variable domain. The second monomer includes a second IgG Fc domain; and a second antigen binding domain comprising a single chain Fv (scFv) region that binds a second Treg marker. In exemplary embodiments, the first and second regulatory Treg markers are selected from the group consisting of CD4 and CD25, CCR4 and CD25, CTLA-4 and CD25, and CTLA-4 and CCR4, respectively.

In exemplary embodiments, the scFv that binds CD25 includes a vhCDR1, vhCDR2, vhCDR3, vlCDR1, vlCDR2, and vlCDR3 of SEQ ID NO: 302. In certain embodiments, the scFv includes a vhCDR1 having the amino acid sequence of SEQ ID NO: 294, a vhCDR2 having the amino acid sequence of SEQ ID NO: 295, a vhCDR3 having the amino acid sequence of SEQ ID NO: 296, a vlCDR1 having the amino acid sequence of g SEQ ID NO: 298, a vlCDR2 having the amino acid sequence of SEQ ID NO: 299, and a vlCDR3 having the amino acid sequence of SEQ ID NO: 300. In certain embodiments, the scFv includes the amino acid sequence of SEQ ID NO: 302.

In some embodiments of the subject heterodimeric antibodies provided herein, the first antigen binding domain is CD4. In certain embodiments, the heavy chain variable domain includes a vhCDR1, vhCDR2, vhCDR3 of SEQ ID NO: 292 and the light chain variable domain includes a vlCDR1, vlCDR2, and vlCDR3 of SEQ ID NO: 307. In certain embodiments, the heavy chain variable domain includes a vhCDR1 having the amino acid sequence of SEQ ID NO 289, a vhCDR2 having the amino acid sequence of SEQ ID NO: 290, and a vhCDR3 having the amino acid sequence of SEQ ID NO: 291, and the light chain variable domain includes a vlCDR1 having the amino acid sequence of SEQ ID NO: 304, a vlCDR2 having the amino acid sequence of SEQ ID NO: 305, and a vlCDR3 having the amino acid sequence of SEQ ID NO: 306. In exemplary embodiments, the heavy chain variable domain includes the amino acid sequence SEQ ID NO: 292 and the light chain variable domain includes the amino acid sequence SEQ ID NO: 307.

In some embodiments of the subject heterodimeric antibodies, the first Treg marker is CCR4. In some embodiments, the heavy chain variable domain includes a vhCDR1, vhCDR2, vhCDR3 of SEQ ID NO: 312 and the light chain variable domain includes a vlCDR1, vlCDR2, and vlCDR3 of SEQ ID NO: 317. In some embodiments, the heavy chain variable domain includes a vhCDR1 having the amino acid sequence of SEQ ID NO: 309, a vhCDR2 having the amino acid sequence of SEQ ID NO: 310, and a vhCDR3 having the amino acid sequence of SEQ ID NO: 311, and the light chain variable domain includes a vlCDR1 having the amino acid sequence of SEQ ID NO: 314, a vlCDR2 having the amino acid sequence of SEQ ID NO: 315, and a vlCDR3 having the amino acid sequence of SEQ ID NO: 316. In certain embodiments, the heavy chain variable domain includes the amino acid sequence of SEQ ID NO: 312 and the light chain variable domain includes the amino acid sequence of SEQ ID NO: 317. In some embodiments, the heavy chain variable domain includes a vhCDR1, vhCDR2, vhCDR3 of SEQ ID NO: 322 and the light chain variable domain includes a vlCDR1, vlCDR2, and vlCDR3 of SEQ ID NO: 327. In certain embodiments, the heavy chain variable domain includes a vhCDR1 having the amino acid sequence of SEQ ID NO: 319, a vhCDR2 having the amino acid sequence of SEQ ID NO: 320, and a vhCDR3 having the amino acid sequence of SEQ ID NO: 321, and the light chain variable domain includes a vlCDR1 having the amino acid sequence of SEQ ID NO: 324, a vlCDR2 having the amino acid sequence of SEQ ID NO: 325, and a vlCDR3 having the amino acid sequence of SEQ ID NO: 326. In some embodiments, the heavy chain variable domain includes the amino acid sequence of SEQ ID NO: 322 and the light chain variable domain includes the amino acid sequence of SEQ ID NO: 327.

In another embodiment of the subject antibody provided herein, the first Treg marker is CTLA-4. In certain embodiments, the heavy chain variable domain includes a vhCDR1, vhCDR2, vhCDR3 of SEQ ID NO: 332 and the light chain variable domain includes a vlCDR1, vlCDR2, and vlCDR3 of SEQ ID NO: 337. In some embodiments, the heavy chain variable domain includes a vhCDR1 having the amino acid sequence of SEQ ID NO: 329, a vhCDR2 having the amino acid sequence of SEQ ID NO: 330, and a vhCDR3 having the amino acid sequence of SEQ ID NO: 331 and the light chain variable domain includes a vlCDR1 having the amino acid sequence of SEQ ID NO: 334, a vlCDR2 having the amino acid sequence of SEQ ID NO: 335, and a vlCDR3 having the amino acid sequence of SEQ ID NO: 336. In some embodiments, the heavy chain variable domain includes the amino acid sequence of SEQ ID NO: 332 and the light chain variable domain includes the amino acid sequence of SEQ ID NO: 337.

In another embodiment, the first and second Treg markers are CTLA-4 and CD25, respectively, and the scFv includes a vhCDR1, vhCDR2, vhCDR3, vlCDR1, vlCDR2, and vlCDR3 of SEQ ID NO: 352. In some embodiments, the scFv includes a vhCDR1 having the amino acid sequence of SEQ ID NO: 344, a vhCDR2 having the amino acid sequence of SEQ ID NO: 345, a vhCDR3 having the amino acid sequence of SEQ ID NO: 346, a vlCDR1 having the amino acid sequence of SEQ ID NO: 348, a vlCDR2 having the amino acid sequence of SEQ ID NO: 349, and a vlCDR3 having the amino acid sequence of SEQ ID NO: 350. In certain embodiments, the scFv includes the amino acid sequence of SEQ ID NO: 352. In exemplary embodiments, the heavy chain variable domain includes a vhCDR1, vhCDR2, vhCDR3 of SEQ ID NO: 342 and the light chain variable domain includes a vlCDR1, vlCDR2, and vlCDR3 of SEQ ID NO: 337. In some embodiments, the heavy chain variable domain includes a vhCDR1 having the amino acid sequence of SEQ ID NO: 339, a vhCDR2 having the amino acid sequence of SEQ ID NO: 340, and a vhCDR3 having the amino acid sequence of SEQ ID NO: 341, and the light chain variable domain includes a vlCDR1 having the amino acid sequence of SEQ ID NO: 334, a vlCDR2 having the amino acid sequence of SEQ ID NO: 335, and a vlCDR3 having the amino acid sequence of SEQ ID NO: 336. In an exemplary embodiment, the heavy chain variable domain includes the amino acid sequence of SEQ ID NO: 342 and the light chain variable domain includes the amino acid sequence of SEQ ID NO: 337.

In another embodiment of the subject heterodimeric antibody, the first Treg marker is CTLA-4 and the second Treg marker is CCR4. In some embodiments, the heavy chain variable domain includes a vhCDR1, vhCDR2, vhCDR3 of SEQ ID NO: 357 and the light chain variable domain includes a vlCDR1, vlCDR2, and vlCDR3 of SEQ ID NO: 372. In certain embodiments, the heavy chain variable domain includes a vhCDR1 having the amino acid sequence of SEQ ID NO: 354, a vhCDR2 having the amino acid sequence of SEQ ID NO: 355, and a vhCDR3 c having the amino acid sequence of SEQ ID NO: 356, and the light chain variable domain includes a vlCDR1 having the amino acid sequence of SEQ ID NO: 369, a vlCDR2 having the amino acid sequence of SEQ ID NO: 370, and a vlCDR3 having the amino acid sequence of SEQ ID NO: 371. In an exemplary embodiment, the heavy chain variable domain includes the amino acid sequence of SEQ ID NO: 357 and the light chain variable domain includes the amino acid sequence of SEQ ID NO: 372.

In some embodiments, the scFv includes a vhCDR1, vhCDR2, vhCDR3, vlCDR1, vlCDR2, and vlCDR3 of SEQ ID NO: 367. In certain embodiments, the scFv includes a vhCDR1 having the amino acid sequence of SEQ ID NO: 359, a vhCDR2 having the amino acid sequence of SEQ ID NO: 360, a vhCDR3 having the amino acid sequence of SEQ ID NO: 361, a vlCDR1 having the amino acid sequence of SEQ ID NO: 363, a vlCDR2 having the amino acid sequence of SEQ ID NO: 364, and a vlCDR3 having the amino acid sequence of SEQ ID NO: 365. In exemplary embodiments, the scFv includes the amino acid sequence SEQ ID NO: 367.

In some embodiments of the subject heterodimeric antibody, the first and second IgG Fc domains of the subject heterodimeric antibody are IgG1 Fc domains. In exemplary embodiments, the first and/or second IG Fc domains is a variant Ig Fc domain comprising an amino acid substitution selected from the group consisting of: 236R, 239D, 239E, 243L, M252Y, V259I, 267D, 267E, 298A, V308F, 328F, 328R, 330L, 332D, 332E, M428L, N434A, N434S, 236R328R, 239D/332E, M428L, 236R/328F, V259I/V308F, 267E/328F, M428L/N434S, Y436I/M428L, Y436V/M428L, Y436I/N434S, Y436V/N434S, 239D/332E/330L, M252Y/S254T/T256E, V259I/V308F/M428L, E233P/L234V/L235A/G236del/S267K, G236R/L328R and PVA/S267K. In certain embodiments, the first and second Ig Fc domains each include the amino acid substitution 239D/332E. In some embodiments, the first and second Ig Fc domains each include the amino acid substitution G236R/L328R or PVA/S267K.

In some embodiments of the subject heterodimeric antibody, the scFv comprises a charged scFv linker. In certain embodiments, the scFv linker is GKPGSGKPGSGKPGS-GKPGS (SEQ ID NO: 287).

In another aspect, provided herein is a nucleic acid composition that includes: a) a first nucleic acid encoding the first monomer of the subject heterodimeric antibody described herein; b) a second nucleic acid encoding the second monomer of the subject heterodimeric antibody described herein; and c) a third nucleic acid encoding the light chain variable domain of the subject heterodimeric antibody described herein.

In yet another aspect, provided herein is a nucleic acid composition that includes: a) a first expression vector that includes the first nucleic acid encoding the first monomer of the subject heterodimeric antibody described herein; b) a second expression vector that includes the second nucleic acid encoding the second monomer of the subject heterodimeric antibody described herein; and c) a third expression vector that includes said third nucleic acid.

In another aspect, provided herein is a host cell that includes any of the nucleic acid compositions described herein.

In another aspect, provided herein is a method of making a composition that includes the step of culturing a subject host cell described herein under conditions where the nucleic acids are expressed and recovering said composition.

In another aspect, provided herein is a method for treating a cancer in a subject in need thereof, the method includes administering to the subject any one of the subject heterodimeric antibodies described herein. In certain embodiments, the cancer is adult T cell leukemia (ATL).

BRIEF DESCRIPTION OF THE DRAWINGS

FIG. 2. Evaluation of the ability of various anti-CD25 heavy chains to pair with anti-CD4 light chains and anti-CD4 heavy chains to pair with anti-CD25 light chains. Biacore was used to examine binding of the various pairs to both CD4 and CD25 and the results tabulated. The HuMax-TAC anti-CD25 heavy chain has the unique ability to pair with the anti-CD4 lights chains of OKT4A and zanolimumab, with the HuMax-TAC/OKT4A pair showing the strongest binding.

FIG. 3. Diagram showing three exemplary anti-CD4× anti-CD25 bispecific formats. Common light-chain, dual scFv, and Fab/scFv-Fc formats are shown. Purification of heterodimer formats is accomplished utilizing Protein A and IEX chromatography. IgG1, FcR enhanced, and/or FcR knockout Fc regions may be used in further embodiments of the invention.

FIG. 23. Summary of IL2 variants that can be used for suppression or induction of Tregs.

FIG. 30A-30FF. Sequences of anti-CD4× anti-CD25 bispecifics, anti-CD4×IL2 Fc-fusions, and control antibodies.

FIG. 31A-31OOO. Sequences of T cell modulating bispecifics, Fc-fusions, and control antibodies.

FIG. 32. Table of exemplary Treg markers for use in embodiments of the invention.

FIG. 33A-33C. Table of exemplary amino acid variants for embodiments of heterodimeric proteins of the invention.

FIG. 34A-34C. Table of exemplary amino acid variants for embodiments of heterodimeric proteins of the invention.

FIG. 35. Table of exemplary amino acid variants for embodiments of heterodimeric proteins of the invention.

FIG. 36A shows the basic concept of a dimeric Fc region with four possible fusion partners A, B, C and D. A, B, C and D are optionally and independently selected from immunoglobulin domain(s) (e.g. Fab, vH, vL, scFv, scFv2, scFab, dAb, etc.), peptide(s), cytokines (e.g. IL-2, IL-10, IL-12, GCSF, GM-CSF, etc.), chemokine(s) (e.g. RANTES, CXCL9, CXCL10, CXCL12, etc.), hormone(s) (e.g. FSH, growth hormone), immune receptor(s) (e.g. CTLA-4, TNFR1, TNFRII, other TNFSF, other TNFRSF, etc.) and blood factor(s) (e.g. Factor VII, Factor VIII, Factor IX, etc.). Domains filled with solid white or solid black are engineered with heterodimerization variants as outlined herein. FIG. 36B depicts the "triple F" format (sometimes also referred to as the "bottle-opener" configuration as discussed below). FIG. 36C shows a "triple F" configuration with another scFv attached to the Fab monomer (this one, along with FIG. 36F, has a greater molecular weight differential as well). FIG. 36D depicts a "triple F" with another scFv attached to the scFv monomer. FIG. 36E depicts a "three scFv" format. FIG. 36F depicts an additional Fab attached to the Fab monomer. FIG. 36G depicts a Fab hooked to one of the scFv monomers. FIGS. 1H-1L show additional varieties of "higher multispecificity" embodiments of the "triple F" format, all with one monomer comprising an scFv (and all of which have molecular weight differentials which can be exploited for purification of the heterodimers). FIG. 36H shows a "Fab-Fv" format with binding to two different antigens, with FIG. 36I depicting the "Fab-Fv" format with binding to a single antigen (e.g. bivalent binding to antigen 1). FIGS. 36J and 36K depicts a "Fv-Fab" format with similar bivalent or monovalent additional antigen binding. FIG. 36L depicts one monomer with a CH1-CL attached to the second scFv. FIG. 36M depicts a dual scFv format.

FIG. 37A-37U. Depicts a wide variety of the multispecific (e.g. heterodimerization) formats and the combinations of different types of heterodimerization variants that can be used in the present invention (these are sometimes referred to herein as "heterodimeric scaffolds"). Note in addition that all of these formats can include addition variants in the Fc region, as more fully discussed below, including "ablation" or "knock out" variants (FIG. 39), Fc variants to alter FcγR binding (FcγRIIb, FcγRIIIa, etc.), Fc variants to alter binding to FcRn receptor, etc. FIG. 37A shows a dual scFv-Fc format, that, as for all heterodimerization formats herein can include heterodimerization variants such as pI variants, knobs in holes (KIH, also referred to herein as steric variants or "skew" variants), charge pairs (a subset of steric variants), isosteric variants, and SEED body ("strand-exchange engineered domain"; see Klein et al., mAbs 4:6 653-663 (2012) and Davis et al, Protein Eng Des Sel 2010 23:195-202) which rely on the fact that the CH3 domains of human IgG and IgA do not bind to each other. FIG. 37B depicts a bispecific IgG, again with the option of a variety of heterodimerization variants. FIG. 37C depicts the "one armed" version of DVD-Ig which utilizes two different variable heavy and variable light domains. FIG. 37D is similar, except that rather than an "empty arm", the variable heavy and light chains are on opposite heavy chains. FIG. 37E is generally referred to as "mAb-Fv". FIG. 37F depicts a multi-scFv format; as will be appreciated by those in the art, similar to the "A, B, C, D" formats discussed herein, there may be any number of associated scFvs (or, for that matter, any other binding ligands or functionalities). Thus, FIG. 37F could have 1, 2, 3 or 4 scFvs (e.g. for bispecifics, the scFv could be "cis" or "trans", or both on one "end" of the molecule). FIG. 37G depicts a heterodimeric FabFc with the Fab being formed by two different heavy chains one containing heavy chain Fab sequences and the other containing light chain Fab sequences. FIG. 37H depicts the "one armed Fab-Fc", where one heavy chain comprises the Fab. FIG. 37I depicts a "one armed scFv-Fc", wherein one heavy chain Fc comprises an scFv and the other heavy chain is "empty". FIG. 37J shows a scFv-CH3, wherein only heavy chain CH3 regions are used, each with their own scFv. FIG. 37K depicts a mAb-scFv, wherein one end of the molecule engages an antigen bivalently with a monovalent engagement using an scFv on one of the heavy chains. FIG. 37L depicts the same structure except that both heavy chains comprise an additional scFv, which can either bind the same antigen or different antigens. FIG. 37N depicts an scFv, FIG. 37O is a "BITE" or scFv-scFv linked by a linker as outlined herein, FIG. 37P depicts a DART, FIG. 37Q depicts a TandAb, and FIG. 37R shows a diabody. FIGS. 37S, 37T and 37U depict additional alternative scaffold formats that find use in the present invention.

FIG. 38. Depicts a list of isotypic and isosteric variant antibody constant regions and their respective substitutions. pI_(−) indicates lower pI variants, while pI_(+) indicates higher pI variants. These can be optionally and independently combined with other heterodimerization variants of the invention.

FIG. 39. Depicts a number of suitable "knock out" ("KO") variants to reduce binding to some or all of the FcγR receptors. As is true for many if not all variants herein, these KO variants can be independently and optionally combined, both within the set described in FIG. 39 and with any heterodimerization variants outlined herein, including steric and pI variants. For example, E233P/L234V/L235A/G236del can be combined with any other single or double variant from the list. In addition, while it is preferred in some embodiments that both monomers contain the same KO variants, it is possible to combine different KO variants on different monomers, as well as have only one monomer comprise the KO variant(s). Reference is also made to the Figures and Legends of U.S. Ser. No. 61/913,870, all of which is expressly incorporated by reference in its entirety as it relates to "knock out" or "ablation" variants.

FIG. 40. Depicts a number of charged scFv linkers that find use in increasing or decreasing the pI of heterodimeric proteins that utilize one or more scFv as a component. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs.

FIG. 41A-41B. FIGS. 41A and 41B provides an additional list of potential heterodimerization variants for use in the present invention, including isotypic variants.

FIG. 42A-42J. Depicts additional exemplary heterodimerization variant pairs for use in heterodimeric proteins of the invention.

FIG. 43. Depicts amino acid sequences of wild-type constant regions used in the invention.

FIG. 44. Depicts two different Triple F embodiments for bispecific antibodies of the invention.

FIG. 45. Literature pIs of the 20 amino acids. It should be noted that the listed pIs are calculated as free amino acids; the actual pI of any side chain in the context of a protein is different, and thus this list is used to show pI trends and not absolute numbers for the purposes of the invention.

FIG. 46A-46C. List of all possible reduced pI variants created from isotypic substitutions of IgG1-4. Shown are the pI values for the three expected species as well as the average delta pI between the heterodimer and the two homodimer species present when the variant heavy chain is transfected with IgG1-WT heavy chain.

FIG. 47. List of all possible increased pI variants created from isotypic substitutions of IgG1-4. Shown are the pI values for the three expected species as well as the average delta pI between the heterodimer and the two homodimer species present when the variant heavy chain is transfected with IgG1-WT heavy chain.

FIG. 48A-48B. Matrix of possible combinations of first and second monomers for heterodimeric proteins of the invention, FcRn variants, Scaffolds, Fc variants and combinations, with each variant being independently and optionally combined from the appropriate source. Note that the target antigens for the first and second monomer are each independently selected from the list provided in the first column. Legend: Legend A are suitable FcRn variants: 434A, 434S, 428L, 308F, 259I, 428L/434S, 259I/308F, 436I/428L, 436I or V/434S, 436V/428L, 252Y, 252Y/254T/256E, 259I/308F/428L. Legend B are suitable scaffolds and include IgG1, IgG2, IgG3, IgG4, and IgG1/2. Sequences for such scaffolds can be found for example in US Patent Publication No. 2012/0128663, published on May 24, 2012, which is hereby incorporated by reference in its entirety for all purposes and in particular for all teachings, figures and legends related to scaffolds and their sequences. Legend C are suitable Fc variants: 236A, 239D, 239E, 332E, 332D, 239D/332E, 267D, 267E, 328F, 267E/328F, 236A/332E, 239D/332E/330Y, 239D, 332E/330L, 236R, 328R, 236R/328R, 236N/267E, 243L, 298A and 299T. (Note, additional suitable Fc variants are found in FIG. 41 of US 2006/0024298, the figure and legend of which are hereby incorporated by reference in their entirety). Legend D reflects the following possible combinations, again, with each variant being independently and optionally combined from the appropriate source Legend: 1) Monomer targets (each independently selected from the list in the first column) plus FcRn variants; 2) Monomer targets (each independently selected from the list in the first column) plus FcRn variants plus Scaffold; 3) Monomer targets (each independently selected from the list in the first column) plus FcRn variants plus Scaffold plus Fc variants; 4) Monomer targets (each independently selected from the list in the first column) plus Scaffold 5) Monomer targets (each independently selected from the list in the first column) plus Fc variants; 6) FcRn variants plus Scaffold; 7) Monomer targets (each independently selected from the list in the first column) plus Fc variants; 8) Scaffold plus Fc variants; 9) Monomer targets (each independently selected from the list in the first column) plus Scaffold plus Fc variants; and 10) Monomer targets (each independently selected from the list in the first column) plus FcRn variants plus Fc variants.

FIG. 50A-50F. Sequence of exemplary "triple F" format bispecific heterodimeric antibodies useful for practicing the subject methods provided herein. Each of the first monomer, second monomer and light chain sequence for XENP15205, XENP15189, XENP16791, XENP15193, XENP15836, XENP16667 are shown in FIG. 50.

FIG. 51A-51UU. Sequences of additional exemplary "triple F" format bispecific heterodimeric antibodies useful for practicing the subject methods provided herein. Three sequences are provided for each "triple F" format antibody in FIG. 51 1) a first monomer, 2) a second monomer that includes an scFv binding domain and 3) a light chain. With respect to the first monomer sequence, the heavy chain variable domain region is bolded and the vhCDR1, vhCDR2, and vhCDR3 regions are underlined. With respect to the second monomer, the heavy chain variable domain and the light chain variable domain are bolded and the vhCDR1, vhCDR2, vhCDR3, vlCDR1, vlCDR2, and vlCDR3 regions are underlined. With respect to the light chain sequence, the variable light chain domain region is bolded and the vhCDR1, vhCDR2, and vhCDR3 regions are underlined.

FIG. 58. MESF antigen density of CTLA4 and CCR4 on different populations of T cells in non-activated and activated PBMC.

FIG. 65A-65C. Graph showing the deletion of Tregs in a single-dose multi-donor MLR assay using heterodimeric antibodies XENP15449 and 16791 described herein.

FIG. 66A-66B. Graph showing the deletion of Tregs in a single-dose multi-donor MLR assay using heterodimeric antibodies XENP16791, 15836, 15205, and 15239 described herein.

DETAILED DESCRIPTION OF EXEMPLARY EMBODIMENTS

Overview of Invention

Figure 1:
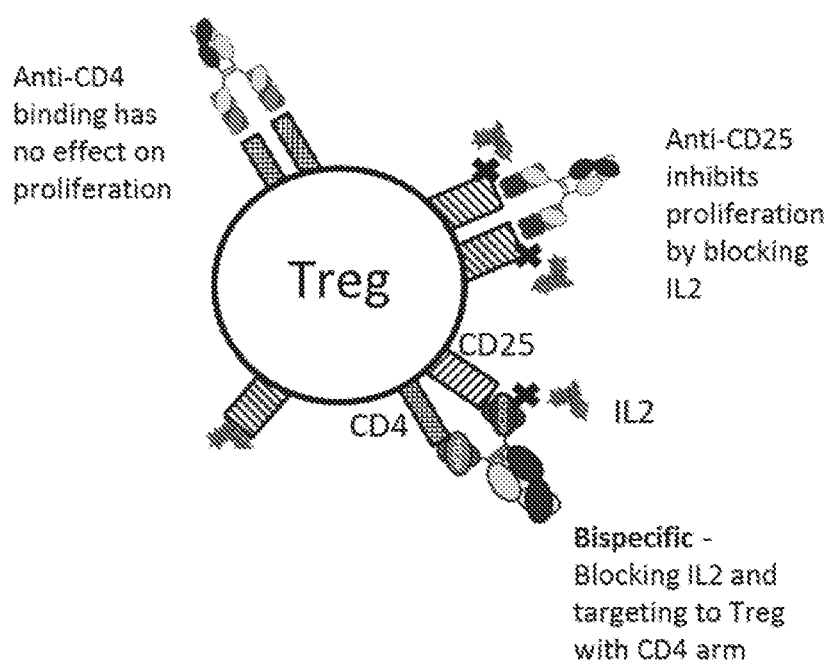
FIG. 1. Diagram illustrating suppression of Treg cells with anti-CD4× anti-CD25 bispecifics.

The present invention provides methods and compositions for modulating T cells by administering heterodimeric proteins. Heterodimeric proteins include without limitation heterodimeric antibodies (such as bispecific antibodies) and heterodimeric fusion proteins. By "modulating T cells" as discussed herein is meant suppressing or stimulating T cells. In general, the heterodimeric proteins of the invention are specific for their target T cell, meaning that the heterodimeric proteins primarily affect one type of T cell with little or no impact on other T cell types. For example (and as is described in further detail herein), methods and compositions of the present invention for suppression or induction of regulatory T cells (also referred to herein as "Tregs") have little or no impact on other T cell types. Similarly, methods and compositions of the invention for suppressing or inducing other T cell types, such as cytotoxic T cells, primarily affect the cytotoxic T cells with little or no impact on other T cell types.

By "suppressing T cells" as used herein refers to decreasing any aspect of T cell expression or function as compared to expression or function in the absence of the administered heterodimeric protein. For example, suppression of regulatory T cells by administering a heterodimeric protein includes suppression of the proliferation of regulatory T cells as compared to proliferation in the absence of the administered heterodimeric protein. "Inducing T cells" as used herein refers to increasing any aspect of T cell expression or function as compared to expression or function in the absence of the administered heterodimeric protein, including stimulation of the proliferation of the target T cell.

As discussed in further detail herein, suppression or induction of T cells can be measured with assays to quantify T cell numbers. For example, cell proliferation assays can be used to detect and quantitate T cells. Other methods of quantifying T cells, particularly Tregs, may also be used, including methods utilizing qPCR to measure the amount of demethylated FOXP3 (a Treg marker) that is present. Such assays are described for example in Wieczorek et al., 2009, Cancer Res, 69(2): 599-608, Vries et al., 2011, Clin Cancer Res, 17:841-848, and Baron et al., 2007, Eur. J. Immunol., 37:2378-2389, each of which is hereby incorporated by reference in its entirety for all purposes and in particular for all teachings, figures and legends related to assays for FOXP3, demethylated FOXP3, and quantification of Tregs.

Suppression of T cells of a particular type is generally accomplished by administering a heterodimeric protein that targets antigens specific for that T cell type. For example, for regulatory T cells, administering a heterodimeric protein that targets both CD4 and CD25 reduces regulatory T cell proliferation with minimal to no effect on other T cells, such as CD4+CD25− T effector cells or CD8+CD25+ cyotoxic T cells. For suppression of T cells, such a heterodimeric protein is generally a bispecific antibody, although other multispecific antibodies and other heterodimeric proteins such as fusion proteins are also contemplated. In certain instances, suppression of regulatory T cells is accomplished by administering a bispecific antibody that targets both CD4 and CD25; in other words, the bispecific antibody comprises two monomers in which one monomer comprises an anti-CD4 binding domain and the other monomer comprises an anti-CD25 binding domain ("binding domain" and "binding moiety" are used interchangeably herein). "Anti-X binding domain" refers to a domain of the monomer that binds to X (i.e., an anti-CD25 binding domain is a part of the monomer that binds to CD25).

Other bispecific antibodies that suppress Tregs include without limitation anti-CD25× anti-CTLA4, anti-CD25× anti-PD-1, anti-CD25× anti-CCR4, and anti-CD25× anti-GITR antibodies.

Bispecific antibodies can also be used to suppress other T cell types, such as cytotoxic T cells. In some instances, one monomer of the bispecific antibody comprises an anti-CD8 domain, including without limitation domains from anti-CD8 antibodies such as MCD8, 3B5, SK1, OKT-8, 51.1 and DK-25. The monomer with the anti-CD8 domain can be combined with a monomer comprising an anti-CD25 binding domain to produce a bispecific antibody for suppression of cytoxic T cells.

Generally, the antigen binding domains of bispecific antibodies of the invention are part of monomers that further comprise at least a heavy chain constant region that contains a variant Fc domain as compared to a parent Fc domain.

In some situations, anti-CD4 and anti-CD8 targeting agents may further be utilized in combination with T cell cytokines, including without limitation IL-7, IL-12, IL-15, and IL-17.

Fc fusion proteins may also be used in accordance with the invention to suppress T cells. For example, a fusion protein comprising an IL2 protein on one arm can be engineered to have reduced ability to bind to IL2Rβ, IL2Rγ, and or IL2Rα in order to ablate IL2 receptor signaling. When coupled with an anti-CD4 antibody (or any other Treg surface marker antibody), this results in an anti-CD4×IL2 Fc-fusion capable of suppressing Treg cells through targeted binding to CD4 and CD25, but without the ability to induce Treg proliferation. In one non-limiting theory, the mechanism of action for this fusion may be that it blocks endogenous IL2 from binding to receptor, thus preventing Treg proliferation. Exemplary embodiments of such fusion proteins are provided in FIG. 23.

Heterodimeric proteins may also be used to induce T cells. As with methods and compositions for suppressing T cells, induction of T cells in accordance with the present invention is generally accomplished by administering a heterodimeric protein that targets antigens and proteins specific for that T cell type. In specific instances, the present invention provides Fc fusion proteins comprising one monomer with a binding domain that targets a T cell marker and a second monomer comprising an IL2 protein. Examples of fusion proteins of use in the present invention for inducing T cells include without limitation fusion proteins that comprise IL2 on one monomer and one of the following binding domains on the other monomer: anti-CD4, anti-CCR4, anti-PD-1, anti-CD8, LAG3, and anti-CTLA4. In some situations, potency of the fusion proteins is increased by engineering the IL2 arm to increase the affinity of IL2 for IL2Rα. Exemplary variants of IL2 of use in the present invention are listed in FIG. 23. Other cytokines that may be used in Fc fusion proteins of the invention include without limitation IL-7, IL-12, IL-15, and IL-17.

As will be appreciated and as is described in further detail herein, the heterodimeric proteins discussed herein may comprise a variety of formats, including those described herein (see for example FIGS. 3, 25, 36 and 37) and those described in the art (see for example Kontermann et al., 2012, Landes Bioscience, which is incorporated herein by reference for all purposes and in particular for all teachings related to heterodimeric proteins such as bispecific antibodies). In some situations, bispecific antibodies may have one heavy chain containing a single chain Fv ("scFv", as defined herein) and the other heavy chain is a "regular" FAb format, comprising a variable heavy chain and a light chain. This structure is sometimes referred to herein as "triple F" format (scFv-FAb-Fc) or the "bottle-opener" format, due to a rough visual similarity to a bottle-opener, as described for example in U.S. Ser. No. 14/205,248, filed Mar. 11, 2014, which is hereby incorporated by reference for all purposes and in particular for all teachings related to the triple F or bottle opener format. In some situations, both of the heavy chains of the bispecific antibodies described herein contain scFvs. Similarly, for any of the fusion proteins described herein, the antibody arm of the fusion protein may be in the scFv or regular FAb format.

As is discussed in further herein, the heterodimeric proteins of the present invention may further include one or more amino acid substitutions in the Fc region that have the effect of increasing serum half-life, ablating binding to FcγR, and/or increasing ADCC. The heterodimeric proteins of the invention may also further include "heterodimerization variants" that, as is also described in further detail herein, promote heterodimeric formation and/or allow for ease of purification of heterodimers over the homodimers. In certain situations, the heterodimeric proteins of the invention comprise one or more variant Fc domains comprising an amino acid variant selected from among the variants listed in FIGS. 33 and 34. In some situations, the amino acid variants may further comprise variants selected from the group: 236R; 239D; 239E; 243L; M252Y; V259I; 267D; 267E; 298A; V308F; 328F; 328R; 330L; 332D; 332E; M428L; N434A; N434S; 236R/328R; 239D/332E; M428L; 236R/328F; V259I/V308F; 267E/328F; M428L/N434S; Y436I/M428L; Y436V/M428L; Y436I/N434S; Y436V/ N434S; 239D/332E/330L; M252Y/S254T/T256E; V259I/ V308F/M428L; and E233P/L234V/L235A/G236del/ S267K.

The methods and compositions of the present invention further include methods for treating and/or alleviating the symptoms of diseases and disorders affected by T cells, including without limitation cancer and autoimmune disease. In particular, methods and compositions of the present invention for the suppression of T cells, particularly Tregs, can be used to treat cancer. In addition, methods and compositions of the present invention for stimulation of T cells can be used to treat autoimmune disease.

As will be appreciated, suppression of T cells in accordance with the present invention may be used to treat any type of cancer. Bispecific antibodies targeting both CD4 and CD25 (or any other combination of T cell markers as described herein and listed in FIG. 32) may in certain further embodiments be beneficial for the treatment of adult T cell leukemia (ATL), a rare disease associated with human T cell lymphotrophic virus (HTLV-1). Diseased cells from ATL patients function as regulatory cells and may arise from Treg cells, since these cells display a $CD4^+CD25^+$ phenotype consistent with that of Treg cells. Depletion of tumor cells with anti-CD4/CD25 bispecific antibodies coupled to an enhanced effector function Fc domain may be a viable treatment option.

As discussed above, the balance of Treg versus effector T cells can be disregulated in autoimmune disease, and therapeutic approaches to favor higher Treg ratios utilizing methods and compositions of the invention can be of use for treating such diseases. Induction and promotion of T cells in accordance with the methods described herein can also be used to treat (i.e., suppress) anti-graft responses in organ transplant and graft-vs-host disease after allogeneic stem cell or bone marrow transplant. Fc-fusion molecules, which in one non-limiting mechanism may selectively 'feed' IL2 to Treg, promote the survival and expansion. Such agents, which should alter the balance in favor of Treg vs effector T cells, may provide a viable treatment option for controlling autoimmune disease, organ transplant rejection, and graft-vs-host disease. In general, such treatments include the use of antibody-IL2 fusion proteins, in particular wherein a single IL2 protein is coupled with an anti-CD4 (or other Treg marker) moiety to provide selectivity for Treg versus effector T cells through the requirement for simultaneous engagement of CD4 and the high-affinity IL-2 receptor CD25.

Treatment of cancer, autoimmune disease or any other T cell associated disease or disorder in accordance with the present invention generally involves administering a composition containing a heterodimeric protein of the invention (antibody or Fc fusion) to a patient in need thereof.

Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. Of particular use in the ablation of FcγR binding are those shown in FIG. 7.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CCC (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233# or E233( ) designates a deletion of glutamic acid at position 233. Additionally, EDA233- or EDA233# designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides", for example the IgG1/2 hybrid of FIG. 13. The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434s, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homophenylalanine, citrulline, ornithine and norleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein. By "Fv" or "Fv fragment" or "Fv region" as used herein is meant a polypeptide that comprises the VL and VH domains of a single antibody.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcqammaR" as used herein is meant any member of the family of proteins that bind the IgG antibody Fc region and is encoded by an FcγR gene. In humans this family includes but is not limited to FcγRI (CD64), including isoforms FcγRIa, FcγR1b, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life, are shown in the Figures.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc fusion protein" or "immunoadhesin" herein is meant a protein comprising an Fc region, generally linked (optionally through a linker moiety, as described herein) to a different protein, such as a binding moiety to a target protein, as described herein. In some cases, one monomer of the heterodimeric protein comprises an antibody heavy chain (either including an scFv or further including a light chain) and the other monomer is a Fc fusion, comprising a variant Fc domain and a ligand. In some embodiments, these "half antibody-half fusion proteins" are referred to as "Fusionbodies".

By "position" as used herein is meant a location in the sequence of a protein. Positions may be numbered sequentially, or according to an established format, for example the EU index for antibody numbering.

By "target antigen" as used herein is meant the molecule that is bound specifically by the variable region of a given antibody. A target antigen may be a protein, carbohydrate, lipid, or other chemical compound. A wide number of suitable target antigens are described below.

By "strandedness" in the context of the monomers of the heterodimeric proteins of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities.

By "target cell" as used herein is meant a cell that expresses a target antigen.

By "variable region" as used herein is meant the region of an immunoglobulin that comprises one or more Ig domains substantially encoded by any of the V.kappa., V.lamda., and/or VH genes that make up the kappa, lambda, and heavy chain immunoglobulin genetic loci respectively.

By "wild type or VVT" herein is meant an amino acid sequence or a nucleotide sequence that is found in nature, including allelic variations. A WT protein has an amino acid sequence or a nucleotide sequence that has not been intentionally modified.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about 10-4 M, at least about 10-5 M, at least about 10-6 M, at least about 10-7 M, at least about 10-8 M, at least about 10-9 M, alternatively at least about 10-10 M, at least about 10-11 M, at least about 10-12 M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction.

Methods and Compositions for Suppressing T Cells

In one aspect, the present invention provides methods and compositions for suppressing T cells (including, for example, "triple F" format Treg bispecific antibodies described herein and known in the art). In preferred embodiments, the methods and compositions for suppressing T cells are specific for one type of T cell with limited to no impact on other T cells. In further embodiments, the methods and compositions of the present invention suppress Tregs with limited to no impact on other T cell types. In other embodiments, the methods and compositions of the present invention suppress cytotoxic T cells with limited to no impact on other T cell types.

In one aspect, the methods and compositions of the present invention suppress T cells by administration of heterodimeric proteins (including bispecific antibodies, such as the "triple F" format Treg bispecific antibodies described herein). Such heterodimeric proteins include without limitation bispecific (although trispecific, tetraspecific and higher order specificities are also contemplated) antibodies and fusion proteins. In certain embodiments, the heterodimeric proteins are "triple F" format Treg bispecific antibodies described herein.

In certain embodiments, suppression of T cells by methods and compositions of the invention serve to increase the numbers and/or proliferation as compared to T cells that were not treated in accordance with the present invention. In further embodiments, administration of any of the heterodimeric proteins (including bispecific antibodies, such as the"triple F" format Treg bispecific antibodies) discussed herein serves to increase the numbers and/or proliferation of T cells over that seen without the administration of the heterodimeric protein (or that seen with administration of a control protein) by at least 5%, 10%, 20%, 30%, 40%, 50%, 60%, 70%, 80%, 90%, 100%, 150%, 200%. In yet further embodiments, the increase in the is about 10-20%, 10-50%, 20-90%, 30-80%, 40-70%, 50-60%. In further embodiments, an increase in numbers and/or proliferation is measured in comparison for the targeted T cell type against the non-targeted type. For example, in embodiments in which the administered heterodimeric protein (including bispecific antibodies, such as the"triple F" format Treg bispecific antibodies) suppresses regulatory T cells, the increase in cell number and/or proliferation of regulatory T cells is measured in comparison to that of other T cell types. In still further embodiments, this comparative increase is at least 5%, 10%, 20%, 30%, 40%, 50%, 60%, 70%, 80%, 90%, 100%, 150%, 200% as compared to the non-targeted T cell type. In yet further embodiments, the comparative increase in the targeted T cell type is about 10-20%, 10-50%, 20-90%, 30-80%, 40-70%, 50-60% over that of the non-targeted T cell type.

In general, the heterodimeric proteins of use for suppression of T cells in accordance with the present invention comprise two monomers, and each monomer comprises a heavy chain constant region with a variant Fc domain as compared to a parent Fc domain and an antigen binding moiety. In certain embodiments, the variant Fc domain of one of the heavy chain constant region of one of the monomers is different than the heavy chain constant region of the other monomer.

In certain aspects, the heterodimeric proteins of the invention for suppression of T cells comprise bispecific antibodies or Fc fusion proteins. The bispecific antibodies of the invention can take any format described herein and known in the art, including those pictured in FIG. 3 and FIGS. 36,37 and 49. The antigen binding domains of these bispecific antibodies will generally comprise an anti-CD25 binding domain on one monomer and a binding domain for a T cell marker on another arm. As will be appreciated, however, any combination of proteins on T cells, including those listed in FIG. 32 can be targets in any combination for bispecific antibodies of the invention. In other words, bispecific antibodies of the invention for suppression of T cells may target any two T cell markers, including any two of those listed in FIG. 32.

In further exemplary embodiments, bispecific antibodies of the invention comprise an anti-CD25 binding domain on one monomer and an anti-CD4 binding domain on the other monomer (such antibodies are also designated herein as anti-CD25× anti-CD4 bispecific antibodies). In further embodiments, the bispecific antibodies of the invention comprise the following combinations of antigen binding domains: anti-CD25× anti-CTLA4, anti-CD25× anti-PD-1, anti-CD25× anti-CCR4, Anti-CD4× Anti-CTLA4 and anti-CD4× Anti-CCR4 and anti-CD25× anti-GITR antibodies.

Treg cells express CD4 and CD25 simultaneously, and targeting both antigens with a bispecific antibody could in one non-limiting theory be a powerful mechanism to selectively suppress Treg cells and allow the immune system to mount a response against tumor cells. Thus, a bispecific antibody allowing for simultaneous avid targeting of CD4 and CD25 (or any other combination of antigens as discussed above) may in certain embodiments reduce Treg cell proliferation, either via cytotoxic depletion or by interfering with IL2-dependent proliferation. Such an approach will in further embodiments have little or no effect on unactivated $CD4^+CD25^-$ T effector cells or $CD8^+CD25^-$ cytotoxic T cells. Although it may exhibit some suppression of activated $CD4^+CD25+$ effector T cells, Tregs are reported to have significantly higher dependence on IL-2 for survival (Malek and Bayer Nature 2004, hereby incorporated by reference in its entirety for all purposes and in particular for all teachings related to T cells), providing additional selectivity of this approach for Treg vs CD4 effector T cells.

Bispecific antibodies can also be used to suppress other T cell types, such as cytotoxic T cells. In some instances, one monomer of the bispecific antibody comprises an anti-CD8 domain, including without limitation domains from anti-CD8 antibodies such as MCD8, 3B5, SK1, OKT-8, 51.1 and DK-25. The monomer with the anti-CD8 domain can be combined with a monomer comprising an anti-CD25 binding domain to produce a bispecific antibody for suppression of cytoxic T cells.

Generally, the antigen binding domains of bispecific antibodies of the invention are part of monomers that further comprise at least a heavy chain constant region that contains a variant Fc domain as compared to a parent Fc domain.

Fc fusion proteins may also be used in accordance with the invention to suppress T cells. For example, a fusion protein comprising an IL2 protein on one arm can be engineered to have reduced ability to bind to $IL2R\beta$, $IL2R\gamma$, and or $IL2R\alpha$ in order to ablate IL2 receptor signaling. When coupled with an anti-CD4 antibody (or any other Treg surface marker antibody), this results in an anti-CD4×IL2 Fc-fusion capable of suppressing Treg cells through targeted binding to CD4 and CD25, but without the ability to induce Treg proliferation. In one non-limiting theory, the mechanism of action for this fusion may be that it blocks endogenous IL2 from binding to receptor, thus preventing Treg proliferation. Exemplary embodiments of such fusion proteins are provided in FIG. 23.

Any of the above described heterodimeric antibodies and fusion proteins for suppressing T cells may further include additional amino acid substitutions in the Fc domain. Such substitutions may include one or any combination of substitutions that affect heterodimer formation, serum half-life and/or binding to FcRn (also referred to herein as "Fc variants"), binding to Fc receptors, or ADCC. Exemplary further substitutions of use in any of the heterodimeric proteins discussed herein for suppression of T cells are listed in FIGS. 38-42 and 48.

Methods and Compositions for Inducing T Cells

In one aspect, the present invention provides methods and compositions for inducing T cells. In preferred embodiments, the methods and compositions for inducing T cells are specific for one type of T cell with limited to no impact on other T cells. In further embodiments, the methods and compositions of the present invention induce Tregs with limited to no impact on other T cell types. In other embodiments, the methods and compositions of the present invention induce cytotoxic T cells with limited to no impact on other T cell types.

"Inducing T cells" as used herein refers to increasing any aspect of T cell expression or function as compared to expression or function in the absence of the administered heterodimeric protein, including stimulation of the proliferation of the target T cell.

As discussed herein and understood in the art, induction (as well as suppression) of T cells can be measured with assays to quantify T cell numbers. For example, cell proliferation assays can be used to detect and quantitate T cells. Other methods of quantifying T cells, particularly Tregs, may also be used, including methods utilizing qPCR to measure the amount of demethylated FOXP3 (a Treg marker) that is present. Such assays are described for example in Wieczorek et al., 2009, Cancer Res, 69(2): 599-608, Vries et al., 2011, Clin Cancer Res, 17:841-848, and Baron et al., 2007, Eur. J. Immunol., 37:2378-2389, each of which is hereby incorporated by reference in its entirety for all purposes and in particular for all teachings, figures and legends related to assays for FOXP3, demethylated FOXP3, and quantification of Tregs. Such assays can also be used to quantify the specificity of induction by providing quantitative measurements of numbers of T cells of one type that are induced as compared to other types of T cells (for example, numbers of Tregs induced as compared to cytotoxic T cells).

In certain embodiments, induction of T cells by methods and compositions of the invention serve to increase the numbers and/or proliferation as compared to T cells that were not treated in accordance with the present invention. In further embodiments, administration of any of the heterodimeric proteins discussed herein serves to increase the numbers and/or proliferation of T cells over that seen without the administration of the heterodimeric protein (or that seen with administration of a control protein) by at least 5%, 10%, 20%, 30%, 40%, 50%, 60%, 70%, 80%, 90%, 100%, 150%, 200%. In yet further embodiments, the increase in the is about 10-20%, 10-50%, 20-90%, 30-80%, 40-70%, 50-60%. In further embodiments, an increase in numbers and/or proliferation is measured in comparison for the targeted T cell type against the non-targeted type. For example, in embodiments in which the administered heterodimeric protein induces regulatory T cells, the increase in cell number and/or proliferation of regulatory T cells is measured in comparison to that of other T cell types. In still further embodiments, this comparative increase is at least 5%, 10%, 20%, 30%, 40%, 50%, 60%, 70%, 80%, 90%, 100%, 150%, 200% as compared to the non-targeted T cell type. In yet further embodiments, the comparative increase in the targeted T cell type is about 10-20%, 10-50%, 20-90%, 30-80%, 40-70%, 50-60% over that of the non-targeted T cell type.

In further aspects, induction of T cells is accomplished in accordance with the present invention using heterodimeric Fc fusion proteins. Such fusion proteins are also referred to herein as "fusionbodies" because they generally comprise two monomers, in which one monomer is an Fc domain fused to a ligand, such as IL2, and the other monomer is a FAb monomer comprising a heavy chain and a light chain.

In certain embodiments, Fc fusion proteins of the invention include one monomer that comprises a T cell protein, including without limitation those proteins listed in FIG. 32. In further embodiments, the monomer comprises all or a portion of an IL2 protein. As will be appreciated, the IL2 protein may comprise an IL2 protein from any source, including any mammalian species. In preferred embodiments, the IL2 portion of the monomer comprises a sequence from human IL2. Variants of IL2 may also be used in Fc fusion proteins of the invention, including without limitation variants such as those listed in FIG. 23.

In further embodiments, the Fc fusion proteins comprise a second monomer that comprises a T cell protein, including without limitation any of the proteins listed in FIG. 32. In exemplary embodiments, the fusionbodies of the present invention for induction of T cells have one monomer that is an Fc domain fused to all or part of an IL2 protein and the second monomer comprises an antigen binding domain that targets one of the following: CD4, CD8, CTLA-4, CCR4, and PD-1. In still further embodiments, the second monomer comprises both a heavy chain and a light chain sequence, and the variable domains of those heavy and light chain sequences form the antigen-binding domain.

Regulatory Tcell (TReg) Bispecific Antibodies

In one aspect, provided herein are Treg bispecific antibodies that include a first antigen binding domain and second antigen binding domain that each bind to a Treg marker. Targeting Treg cells with a conventional antibody to one of the Treg surface markers will likely lead to simultaneous binding to effector T cells or other cell types sharing the same surface markers. However, without being bound by any particular theory of operation, it is believed that targeting two or more (e.g. CD4×CD25, CCR4×CD25, CTLA4×CD25, CCR4×CTLA4, etc.) antigens with a subject bispecific antibody allow more specific suppression and/or induction of Treg cells. The ability to modulate Treg cells is useful, for example, in suppressing Treg population to allow the immune system to mount a response against tumor cells in a cancer.

In some embodiments, the bispecific antibody binds to two Treg markers. Any suitable Treg markers can be used including, but not limited to: CD4, CD25, CTLA4, PD-1, CCR4, GITR, LAG-3, CD62L, CD39, CD44, LAP, CD103, CCR5, CCR6, GARP, Galectin-1, TNFRSF25, Neuropilin-1, GPR83, CD26, CD45RA, CD45RO, CD49d, CD101, FR4, CD31, CD137, OX40, and TIM-3. In some embodiments, the first and second antigen binding domains bind the same Treg marker. In some embodiments, the first and second antigen binding domains bind to two different Treg marker.

Figure 49:
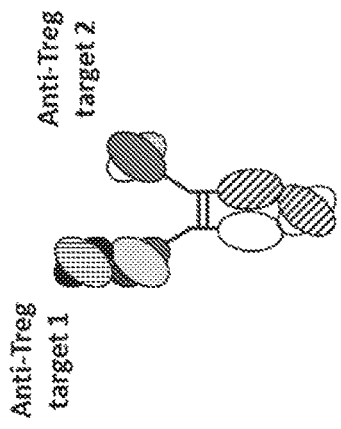
FIG. 49. Depicts an exemplary subject "triple F" format or "bottle opener" bispecific antibody that includes two antigen binding domains that bind Treg markers. Such subject "triple F" format bispecific antibodies are useful, for example, depletion of Treg cells.

In some embodiments, the bispecific antibody is a "triple F" format bispecific antibody, for example, as shown in FIG. 49. Such triple F format antibodies described herein include a first monomer that includes a a first IgG Fc domain and first antigen binding domain and a second monomer that includes a a second IgG Fc domain second antigen binding domain that is an scFv. In some embodiments, the first antibody binding domain includes a heavy chain variable domain (VH) and a light chain variable domain (VL). In some embodiments, the first binding domain includes a Fab. As used herein, a "Fab" and "Fab region" refer to a polypeptide that comprises the VH, CH1, VL, and CL immunoglobulin domains. In some embodiments, the first antigen binding domain (e.g., a "regular Fab" domain) binds CD4, CD25, CTLA4, PD-1, CCR4, GITR, LAG-3, CD62L, CD39, CD44, LAP, CD103, CCR5, CCR6, GARP, Galectin-1, TNFRSF25, Neuropilin-1, GPR83, CD26, CD45RA, CD45RO, CD49d, CD101, FR4, CD31, CD137, OX40, and TIM-3. In some embodiments, the second antigen binding domain (e.g., scFv) binds CD4, CD25, CTLA4, PD-1, CCR4, GITR, LAG-3, CD62L, CD39, CD44, LAP, CD103, CCR5, CCR6, GARP, Galectin-1, TNFRSF25, Neuropilin-1, GPR83, CD26, CD45RA, CD45RO, CD49d, CD101, FR4, CD31, CD137, OX40, and TIM-3.

The sequences of exemplary "triple F" format bispecific antibodies useful for practice with the subject methods are included in FIGS. 50 and 51. In some embodiments, the subject antibody includes an scFv according to any of the scFv amino acid sequences in FIGS. 50 and 51. In certain embodiments, the subject antibody includes a heavy chain variable domain and a light chain variable domain according to any of the heavy chain variable domain and light chain variable domain in FIGS. 50 and 51. In some embodiments, the subject antibody includes a vhCDR1, vhCDR2, vhCDR3 of any heavy chain variable domain and a vlCDR1, vlCDR2, and vlCDR3 of any light chain variable domain of FIGS. 50 and 51.

In some embodiments, the first antigen binding domain and second antigen binding domain bind CD4 and CD25; CCR4 and CD25; CTLA-4 and CD25; or CTLA-4 and CCR42, respectively.

In some embodiments, one of the first and second antigen binding domains binds CD25. In some embodiments, the first or second antigen binding domain includes a vhCDR1, vhCDR2, vhCDR3, vlCDR1, vlCDR2, and vlCDR3 of SEQ ID NO: 302. In some embodiments, the first or second antigen binding domain includes a vhCDR1 having the amino acid sequence of SEQ ID NO: 294, a vhCDR2 having the amino acid sequence of SEQ ID NO: 295, a vhCDR3 having the amino acid sequence of SEQ ID NO: 296, a vlCDR1 having the amino acid sequence of SEQ ID NO: 298, a vlCDR2 having the amino acid sequence of SEQ ID NO: 299, and a vlCDR3 having the amino acid sequence of SEQ ID NO: 300. In certain embodiments, the first or second antigen binding domain is an scFv having the amino acid sequence of SEQ ID NO: 302. In some embodiments, the antibody is a "triple F" format antibody that includes an scFv having the amino acid sequence of SEQ ID NO: 302.

In an exemplary embodiment, the bispecific antibody binds CD25 and CD4. In some embodiments, the antibody is a "triple F" format antibody that includes a first antigen binding domain that binds CD4 and a second antigen binding domain that binds CD25. In some embodiments, the first antigen binding domain includes a heavy chain variable domain and a light chain variable domain and the second antigen binding domain is an scFv. In some embodiments, the first antigen binding domain is an scFv and the second antigen binding domain includes a heavy chain variable domain and a light chain variable domain. In certain embodiments, the heavy chain variable domain includes a vhCDR1, vhCDR2, vhCDR3 of SEQ ID NO: 292 and the light chain variable domain includes a vlCDR1, vlCDR2, and vlCDR3 of SEQ ID NO: 307. In exemplary embodiments, the heavy chain variable domain includes a vhCDR1 having the amino acid sequence of SEQ ID NO 289, a vhCDR2 having the amino acid sequence of SEQ ID NO: 290, and a vhCDR3 having the amino acid sequence of SEQ ID NO: 291, and the light chain variable domain includes a vlCDR1 having the amino acid sequence of SEQ ID NO: 304, a vlCDR2 having the amino acid sequence of SEQ ID NO: 305, and a vlCDR3 having the amino acid sequence of SEQ ID NO: 306. In some embodiments, the heavy chain variable domain includes the amino acid sequence of SEQ ID NO: 292 and the light chain variable domain includes the amino acid sequence of SEQ ID NO: 307. In certain embodiments, the antibody is a "triple F" format antibody having a first monomer that includes the amino acid sequence of SEQ ID NO: 288, a second monomoner that includes the amino acid sequence of SEQ ID NO: 293, and a light chain that includes the amino acid sequence of SEQ ID NO: 307.

In an exemplary embodiment, the bispecific antibody binds CD25 and CCR4. In some embodiments, the antibody is a "triple F format antibody" that includes a first antigen binding domain that binds CCR4 and a second antigen binding domain that binds CD25. In some embodiments, the first antigen binding domain includes a heavy chain variable domain and a light chain variable domain and the second antigen binding domain is an scFv. In some embodiments, the heavy chain variable domain includes a vhCDR1, vhCDR2, vhCDR3 of SEQ ID NO: 312 and the light chain variable domain includes a vlCDR1, vlCDR2, and vlCDR3 of SEQ ID NO: 317. In certain embodiments, the heavy chain variable domain includes a vhCDR1 having the amino acid sequence of SEQ ID NO: 309, a vhCDR2 having the amino acid sequence of SEQ ID NO: 310, and a vhCDR3 having the amino acid sequence of SEQ ID NO: 311, and the light chain variable domain includes a vlCDR1 having the amino acid sequence of SEQ ID NO: 314, a vlCDR2 having the amino acid sequence of SEQ ID NO: 315, and a vlCDR3 having the amino acid sequence of SEQ ID NO: 316. In exemplary embodiments, the heavy chain variable domain includes the amino acid sequence of SEQ ID NO: 312 and the light chain variable domain includes the amino acid sequence of SEQ ID NO: 317. In certain embodiments, the antibody is a "triple F" format antibody having a first monomer that includes the amino acid sequence of SEQ ID NO: 308, a second monomoner that includes the amino acid sequence of SEQ ID NO: 293, and a light chain that includes the amino acid sequence of SEQ ID NO: 313.

In an exemplary embodiment of a bispecific antibody that binds CD25 and CCR4, the antibody is a "triple F format antibody" that includes a first antigen binding domain that binds CCR4 and a second antigen binding domain that binds CD25. In some embodiments, the heavy chain variable domain includes a vhCDR1, vhCDR2, vhCDR3 of SEQ ID NO: 322 and the light chain variable domain includes a vlCDR1, vlCDR2, and vlCDR3 of SEQ ID NO: 327. In exemplary embodiments, the heavy chain variable domain includes a vhCDR1 having the amino acid sequence of SEQ ID NO: 319, a vhCDR2 having the amino acid sequence of SEQ ID NO: 320, and a vhCDR3 having the amino acid sequence of SEQ ID NO: 321, and the light chain variable domain includes a vlCDR1 having the amino acid sequence of SEQ ID NO: 324, a vlCDR2 having the amino acid sequence of SEQ ID NO: 325, and a vlCDR3 having the amino acid sequence of SEQ ID NO: 326. In some embodiments, the heavy chain variable domain includes the amino acid sequence of SEQ ID NO: 322 and the light chain variable domain includes the amino acid sequence of SEQ ID NO: 327. In certain embodiments, the antibody is a "triple F" format antibody having a first monomer that includes the amino acid sequence of SEQ ID NO: 318, a second monomoner that includes the amino acid sequence of SEQ ID NO: 293, and a light chain that includes the amino acid sequence of SEQ ID NO: 323.

In another exemplary embodiment, the bispecific antibody binds CD25 and CTLA-4. In some embodiments, the antibody is a "triple F format antibody" that includes a first antigen binding domain that binds CTLA-4 and a second antigen binding domain that binds CD25. In some embodiments, the first antigen binding domain includes a heavy chain variable domain and a light chain variable domain and the second antigen binding domain is an scFv. In some embodiments, the heavy chain variable domain includes a vhCDR1, vhCDR2, vhCDR3 of SEQ ID NO: 332 and the light chain variable domain includes a vlCDR1, vlCDR2, and vlCDR3 of SEQ ID NO: 337. In exemplary embodiments, the heavy chain variable domain includes a vhCDR1 having the amino acid sequence of SEQ ID NO: 329, a vhCDR2 having the amino acid sequence of SEQ ID NO: 330, and a vhCDR3 having the amino acid sequence of SEQ ID NO: 331, and the light chain variable domain includes a vlCDR1 having the amino acid sequence of SEQ ID NO: 334, a vlCDR2 having the amino acid sequence of SEQ ID NO: 335, and a vlCDR3 having the amino acid sequence of SEQ ID NO: 336. In certain embodiments, the heavy chain variable domain includes the amino acid sequence SEQ ID NO: 332 and the light chain variable domain includes the amino acid sequence SEQ ID NO: 337. In certain embodiments, the antibody is a "triple F" format antibody having a first monomer that includes the amino acid sequence of SEQ ID NO: 328, a second monomoner that includes the amino acid sequence of SEQ ID NO: 293, and a light chain that includes the amino acid sequence of SEQ ID NO: 333.

In an exemplary embodiment of a bispecific antibody that binds CD25 and CTLA-4, the antibody is a "triple F format antibody" that includes a first antigen binding domain that binds CTLA-4 and a second antigen binding domain that binds CD25. In some embodiments, the first antigen binding domain includes a heavy chain variable domain and a light chain variable domain and the second antigen binding domain is an scFv. In certain embodiments, the scFv includes a vhCDR1, vhCDR2, vhCDR3, vlCDR1, vlCDR2, and vlCDR3 of SEQ ID NO: 352. In some embodiments, the scFv includes a vhCDR1 having the amino acid sequence of SEQ ID NO: 344, a vhCDR2 having the amino acid sequence of SEQ ID NO: 345, a vhCDR3 having the amino acid sequence of SEQ ID NO: 346, a vlCDR1 having the amino acid sequence of SEQ ID NO: 348, a vlCDR2 having the amino acid sequence of SEQ ID NO: 349, and a vlCDR3 having the amino acid sequence of SEQ ID NO: 350. In certain embodiments, the scFv includes the amino acid sequence of SEQ ID NO: 352. In an exemplary embodiment, the heavy chain variable domain includes a vhCDR1, vhCDR2, vhCDR3 of SEQ ID NO: 342 and the light chain variable domain includes a vlCDR1, vlCDR2, and vlCDR3 of SEQ ID NO: 337. In some embodiments, the heavy chain variable domain includes a vhCDR1 having the amino acid sequence of SEQ ID NO: 339, a vhCDR2 having the amino acid sequence of SEQ ID NO: 340, and a vhCDR3 having the amino acid sequence of SEQ ID NO: 341, and the light chain variable domain includes a vlCDR1 having the amino acid sequence of SEQ ID NO: 334, a vlCDR2 having the amino acid sequence of SEQ ID NO: 335, and a vlCDR3 having the amino acid sequence of SEQ ID NO: 336. In exemplary embodiments, the heavy chain variable domain includes the amino acid sequence of SEQ ID NO: 342 and the light chain variable domain includes the amino acid sequence of SEQ ID NO: 337. In certain embodiments, the antibody is a "triple F" format antibody having a first monomer that includes the amino acid sequence of SEQ ID NO: 338, a second monomoner that includes the amino acid sequence of SEQ ID NO: 243, and a light chain that includes the amino acid sequence of SEQ ID NO: 333.

In another exemplary embodiment, the bispecific antibody binds CTLA-4 and CCR4. In some embodiments, the antibody is a "triple F format antibody" that includes a first antigen binding domain that binds CTLA-4 and a second antigen binding domain that binds CCR4. In some embodiments, the first antigen binding domain includes a heavy chain variable domain and a light chain variable domain and the second antigen binding domain is an scFv. In some embodiments, the heavy chain variable domain includes a vhCDR1, vhCDR2, vhCDR3 of SEQ ID NO: 357 and the light chain variable domain includes the vlCDR1, vlCDR2, and vlCDR3 of SEQ ID NO: 372. In some embodiments, the heavy chain variable domain includes a vhCDR1 having the amino acid sequence of SEQ ID NO: 354, a vhCDR2 having the amino acid sequence of SEQ ID NO: 355, and a vhCDR3 having the amino acid sequence of SEQ ID NO: 356, and the light chain variable domain includes a vlCDR1 having the amino acid sequence of SEQ ID NO: 369, a vlCDR2 having the amino acid sequence of SEQ ID NO: 370, and a vlCDR3 having the amino acid sequence of SEQ ID NO: 371. In some embodiments, the heavy chain variable domain includes the amino acid sequence of SEQ ID NO: 357 and the light chain variable domain includes the amino acid sequence of SEQ ID NO: 372. In an exemplary embodiment, the scFv includes a vhCDR1, vhCDR2, vhCDR3, vlCDR1, vlCDR2, and vlCDR3 of SEQ ID NO: 367. In some embodiments, the scFv includes a vhCDR1 having the amino acid sequence of SEQ ID NO: 359, a vhCDR2 having the amino acid sequence of SEQ ID NO: 360, a vhCDR3 having the amino acid sequence of SEQ ID NO: 361, a vlCDR1 having the amino acid sequence of SEQ ID NO: 363, a vlCDR2 having the amino acid sequence of SEQ ID NO: 364, and a vlCDR3 having the amino acid sequence of SEQ ID NO: 365. In some embodiments, the scFv includes the amino acid sequence of SEQ ID NO: 367.

The first and second IgG Fc domains of the Treg bispecific antibodies provided herein (e.g., "triple F" format Treg bispecific antibodies described herein) include wild type IgG Fc domains and IgG Fc domains having amino acid substitutions, including but not limited to the one or more of the IgG Fc domain amino acid substitutions described herein. In some embodiments, the first and second IgG Fc domains are wild type IgG1 Fc domains. In some embodiments, the first and/or second Ig Fc domains is a variant Ig Fc domain that includes one or more of the following amino acid substitutions: 236R, 239D, 239E, 243L, M252Y, V259I, 267D, 267E, 298A, V308F, 328F, 328R, 330L, 332D, 332E, M428L, N434A, N434S, 236R/328R, 239D/332E, M428L, 236R/328F, V259I/V308F, 267E/328F, M428L/N434S, Y436I/M428L, Y436V/M428L, Y436I/N434S, Y436V/N434S, 239D/332E/330L, M252Y/S254T/T256E, V259I/V308F/M428L, and E233P/L234V/L235A/G236del/S267K. In certain embodiments, the first and second Ig Fc domains each include the amino acid substitution 239D/332E. In some embodiments, the first and second Ig Fc domains each include the amino acid substitution E233P/L234V/L235A/G236del/S267K.

In some embodiments, the the first and second Ig Fc domains include the amino acid substitution S364K/E357Q and L368D/K370S; L368D/K370S and S364K; L368D/K370S and S364K/E357L; T411E/K360E/Q362E and D401K; L368E/K370S and S364K; K370S and S364K/E357Q; K37S and S364K/E357Q and L368E/K370S and S364K/E357Q, respectively (FIG. 42D). In certain embodiments, the second and first Ig Fc domains include the amino acid substitution S364K/E357Q and L368D/K370S; L368D/K370S and S364K; L368D/K370S and S364K/E357L; T411E/K360E/Q362E and D401K; L368E/K370S and S364K; K370S and S364K/E357Q; K370S and S364K/E357Q and L368E/K370S and S364K/E357Q, respectively.

Methods of Making Compositions

Any of the heterodimeric proteins discussed herein, including bispecific antibodies and heterodimeric Fc fusion proteins, can be made using methods known in the art and methods described in further detail herein.

In certain aspects, the invention provides one or more nucleic acids encoding a composition according to any of the compositions described herein. As will be appreciated, different monomers of the heterodimeric proteins of the invention may be expressed using nucleic acids encoding all or a portion of one or more of the monomers of the protein. Thus, for example, for a bispecific antibody in which one monomer targets CD4 and the other monomer target CD25, the present invention further provides a nucleic acid encoding the first and second monomers as separate molecules that are then assembled together by co-expression in the same host cell. In other embodiments, the two monomers may be encoded in the same nucleic acid, in some embodiments within the same vector. In embodiments in which one or both of the monomers comprise both heavy and light chain sequences, those sequences may also be encoded by one or by multiple nucleic acids.

In further embodiments, the invention further provides host cells expressing the one or more nucleic acids encoding the one or more monomers of heterodimeric proteins of the invention. As will be appreciated and as is discussed above, the heterodimeric proteins of the present invention may be encoded by one or more nucleic acids. These one or more nucleic acids may be expressed in a single host cell or in separate host cells. For example, for heterodimeric proteins that are in the bottle-opener format in which one of the monomers is an scFv and the other monomer is a FAb, there may be three nucleic acids encoding this protein: one for the scFv, one for the heavy chain sequence of the FAb, and one for the light chain sequence of the FAb. These three nucleic acids will in general be expressed in the same host cell in order to produce the heterodimeric protein, although expression in separate host cells is also contemplated.

In yet further embodiments, and in accordance with any of the above, the present invention provides a method of making any of the compositions described herein, the method including the step of culturing a host cell or more nucleic acids encoding a heterodimeric protein of the invention, including any of the bispecific antibodies or Fc fusion proteins described herein.

In further aspects, the present invention provides a method of purifying a heterodimeric protein or bispecific antibody in accordance with any of the above, the method including: (a) providing a composition in accordance with any of the heterodimeric proteins described herein, (b) loading the composition onto an ion exchange column; and (c) collecting a fraction containing the heterodimeric protein or bispecific antibody, thus purifying the protein or antibody.

Heterodimeric Proteins Overview

The present invention is directed to methods of modulating T cells using novel constructs to provide heterodimeric proteins that allow binding to more than one antigen or ligand, e.g. to allow for multispecific binding. The heterodimeric protein constructs are based on the self-assembling nature of the two Fc domains of the heavy chains of antibodies, e.g. two "monomers" that assemble into a "dimer". Heterodimeric proteins are made by altering the amino acid sequence of each monomer as more fully discussed below. Thus, the present invention is generally directed to the creation of heterodimeric proteins including antibodies, which can co-engage antigens in several ways, relying on amino acid variants in the constant regions that are different on each chain to promote heterodimeric formation and/or allow for ease of purification of heterodimers over the homodimers. As discussed more fully below, the heterodimeric proteins can be antibody variants or based on Fc fusion proteins. Although much of the following discussion is in terms of heterodimeric antibodies, it will be appreciated by those in the art and more fully described below, the discussion applies equally to heterodimeric proteins that are based on Fc fusion proteins (also referred to herein as fusionbodies).

Thus, the present invention provides bispecific antibodies (or, as discussed below, trispecific or tetraspecific antibodies can also be made). An ongoing problem in antibody technologies is the desire for "bispecific" (and/or multispecific) antibodies that bind to two (or more) different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B). However, a major obstacle in the formation of multispecific antibodies is the difficulty in purifying the heterodimeric antibodies away from the homodimeric antibodies and/or biasing the formation of the heterodimer over the formation of the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers.

One mechanism is generally referred to in the art as "knobs and holes" ("KIH") or sometimes herein as "skew" variants, referring to amino acid engineering that creates steric influences to favor heterodimeric formation and disfavor homodimeric formation can also optionally be used; this is sometimes referred to as "knobs and holes"; as described in U.S. Ser. No. 61/596,846 and U.S. Ser. No. 12/875,0015, Ridgway et al., Protein Engineering 9(7):617 (1996); Atwell et al., J. Mol. Biol. 1997 270:26; U.S. Pat. No. 8,216,805, US 2012/0149876, all of which are hereby incorporated by reference in their entirety. The Figures identify a number of "monomer A monomer B" pairs that include "knobs and holes" amino acid substitutions. In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" or "charge pairs" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R and others shown in the Figures.

In the present invention, in some embodiments, pI variants are used to alter the pI of one or both of the monomers and thus allowing the isoelectric purification of A-A, A-B and B-B dimeric proteins.

In the present invention, there are several basic mechanisms that can lead to ease of purifying heterodimeric proteins; one relies on the use of pI variants, such that each monomer has a different pI, thus allowing the isoelectric purification of A-A, A-B and B-B dimeric proteins. Alternatively, some scaffold formats, such as the "triple F" format, also allows separation on the basis of size. As is further outlined below, it is also possible to "skew" the formation of heterodimers over homodimers. Thus, a combination of steric heterodimerization variants and pI or charge pair variants find particular use in the invention. Additionally, as more fully outlined below, scaffolds that utilize scFv(s) such as the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide the use of skew variants with charged scFv linkers as well (and combinations of Fc, FcRn and KO variants).

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (aspartic acid to lysine) or changing a charged residue to a neutral residue (e.g. loss of a charge; lysine to serine.). A number of these variants are shown in the Figures.

Accordingly, in this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A–+B or wt A– –B), or by increasing one region and decreasing the other region (A+ –B– or A– B+).

Thus, in general, a component of some embodiments of the present invention are amino acid variants in the constant regions of antibodies that are directed to altering the isoelectric point (pI) of at least one, if not both, of the monomers of a dimeric protein to form "pI heterodimers" (when the protein is an antibody, these are referred to as "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

Figure 37A:
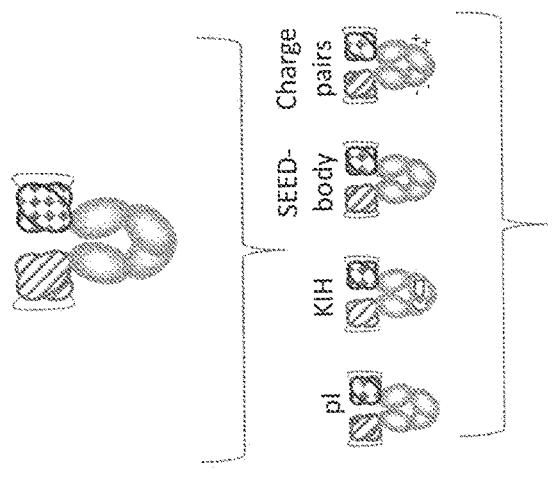
Figure 37M:
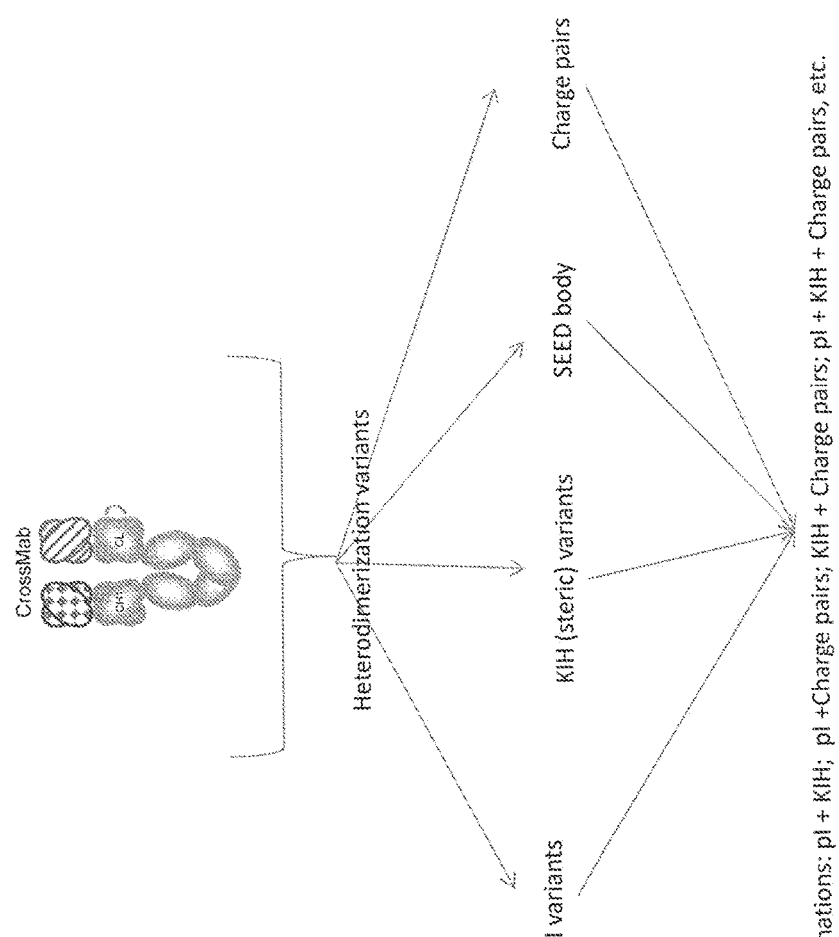
FIG. 37M shows the "CrossMab" structure, where the problem of multiplex formation due to two different light chains is addressed by switching sequences in the Fab portion.

Furthermore, as will be appreciated by those in the art and outlined herein, heterodimers can be separated from homodimers on the basis of size. For example, as shown in FIGS. 36 and 37, heterodimers with two scFvs can be separated by those of the "triple F" format and a bispecific mAb. This can be further exploited in higher valency with additional antigen binding sites being utilized. For example, as additionally shown, one monomer will have two Fab fragments and the other will have one scFv, resulting in a differential in size and thus molecular weight.

In addition, as will be appreciated by those in the art and outlined herein, the format outlined herein can be expanded to provide trispecific and tetraspecific antibodies as well. In this embodiment, some variations of which are depicted in the FIG. 36A, it will be recognized that it is possible that some antigens are bound divalently (e.g. two antigen binding sites to a single antigen; for example, A and B could be part of a typical bivalent association and C and D can be optionally present and optionally the same or different). As will be appreciated, any combination of Fab and scFvs can be utilized to achieve the desired result and combinations.

In the case where pI variants are used to achieve heterodimerization, by using the constant region(s) of the heavy chain(s), a more modular approach to designing and purifying multispecific proteins, including antibodies, is provided. Thus, in some embodiments, heterodimerization variants (including skew and purification heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of bispecific antibodies, the ability to eliminate, minimize and/or distinguish when homodimers are present is significant. Similarly, the ability to reliably test the reproducibility of the heterodimeric protein production is important.

In addition to all or part of a variant heavy constant domain, one or both of the monomers may contain one or two fusion partners, such that the heterodimers form multivalent proteins. As is generally depicted in the Figures, and specifically FIG. 36A, the fusion partners are depicted as A, B, C and D, with all combinations possible. In general, A, B, C and D are selected such that the heterodimer is at least bispecific or bivalent in its ability to interact with additional proteins.

As will be appreciated by those in the art and discussed more fully below, the heterodimeric fusion proteins of the present invention can take on a wide variety of configurations, as are generally depicted in FIGS. 36 and 37. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Furthermore as is shown, these two configurations can be combined, where there can be triple or quadruple specificities based on the particular combination. Thus, the present invention provides "multispecific" binding proteins, including multispecific antibodies. Thus, the present invention is directed to novel immunoglobulin compositions that coengage at least a first and a second antigen. First and second antigens of the invention are herein referred to as antigen-1 and antigen-2 respectively.

One heterodimeric scaffold that finds particular use in the present invention is the "triple F" or "bottle opener" scaffold format. In this embodiment, one monomer of the antibody contains a single chain Fv ("scFv", as defined below) and the other monomer is a "regular" FAb format, comprising a heavy chain variable domain and a light chain variable domain. This structure is sometimes referred to herein as "triple F" format (scFv-FAb-Fc) or the "bottle-opener" format, due to a rough visual similarity to a bottle-opener (see FIGS. 36B and 49). The two chains are brought together by the use of amino acid variants in the constant regions (e.g. the Fc domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.)

Figure 64:
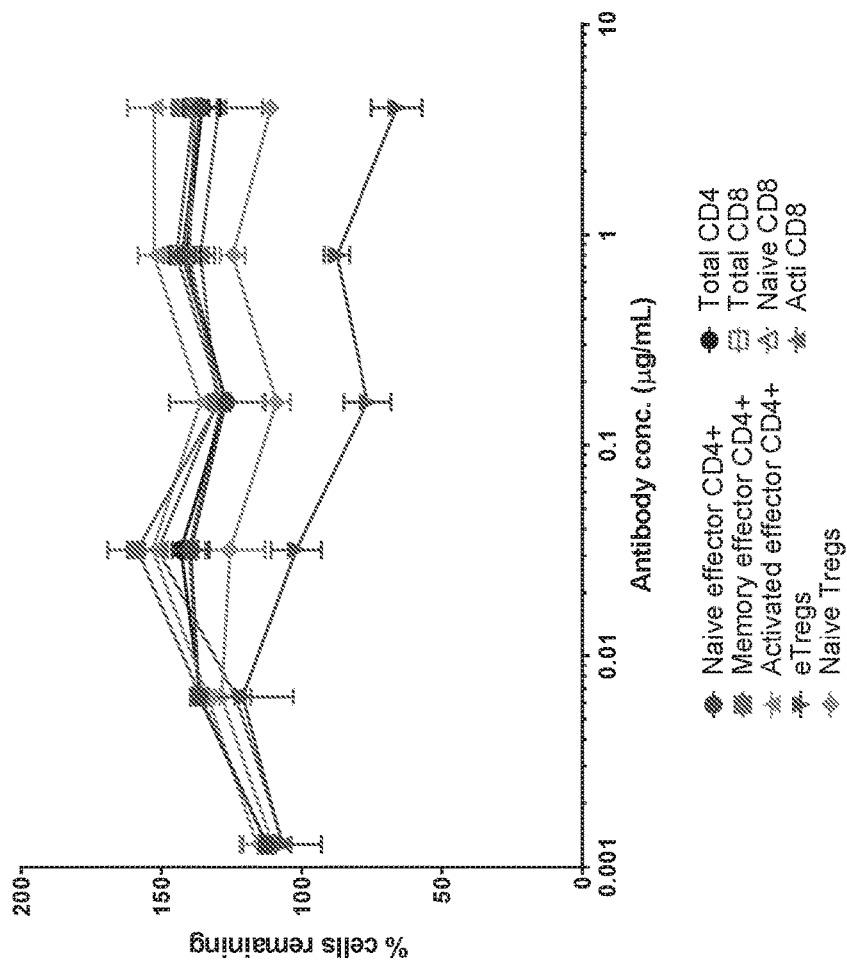
FIG. 64. Lack of depletion of T cell populations in non-activated PBMC by the isotype control antibody Anti-RSV.
Figure 65A:
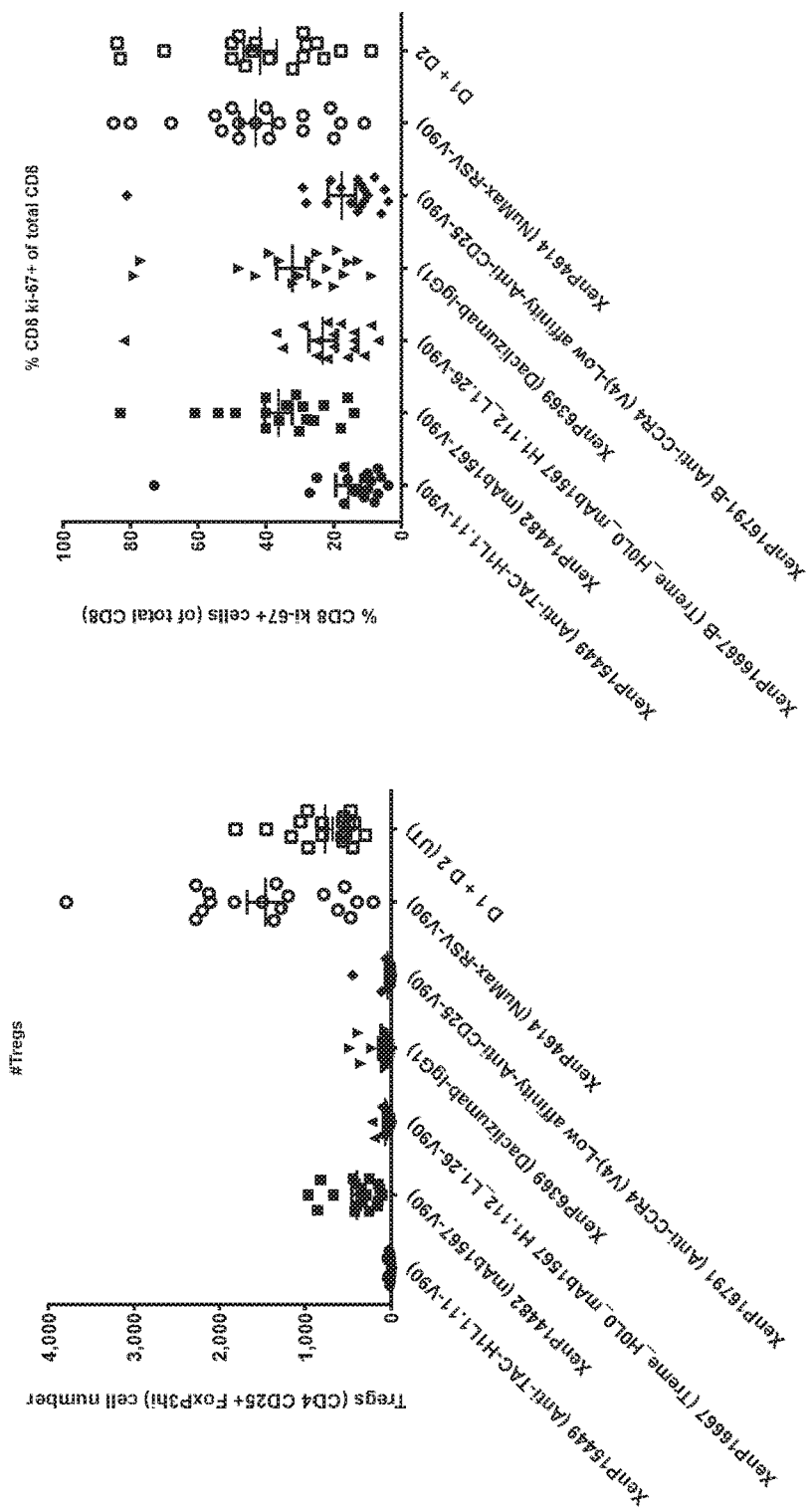
Figure 65B:
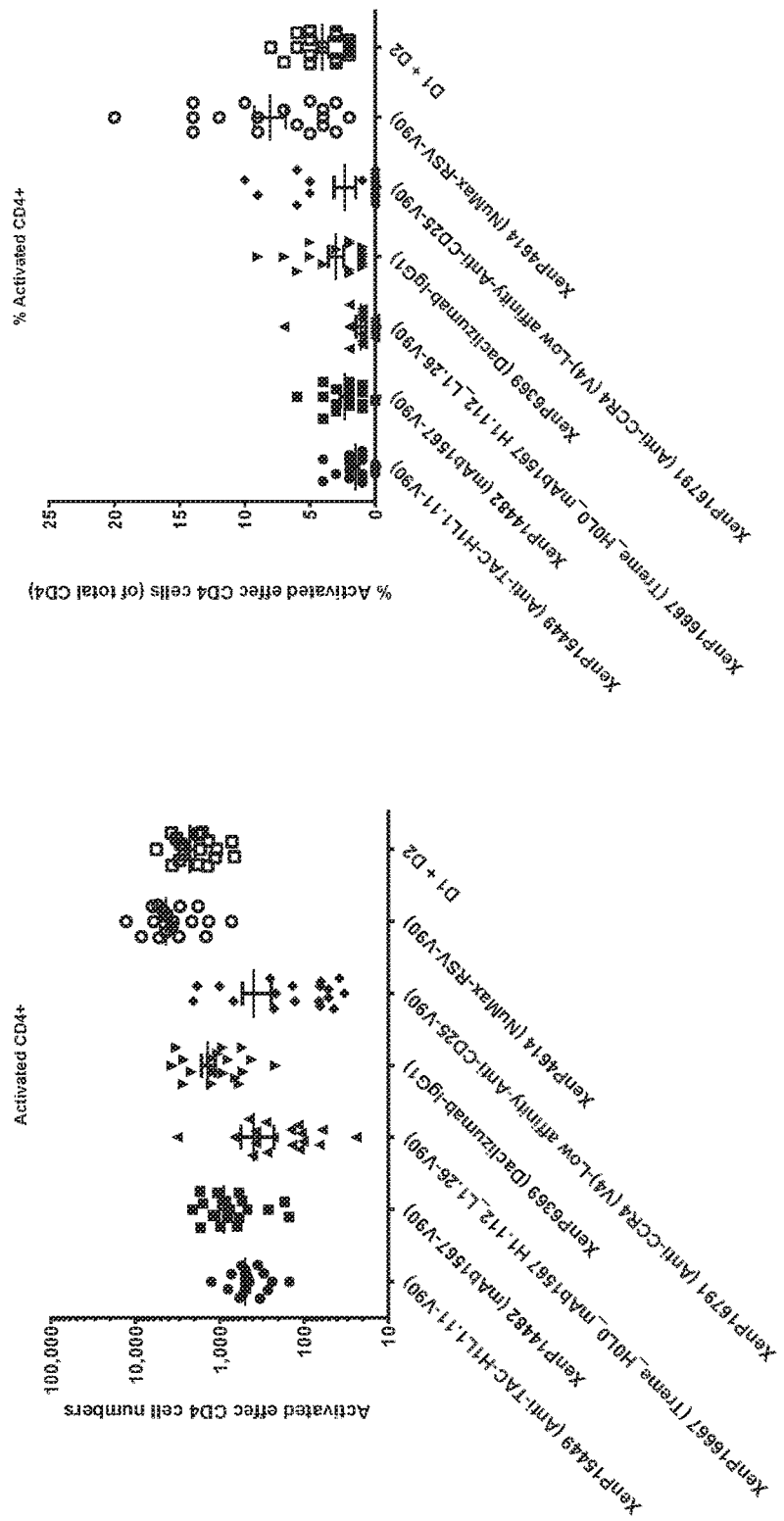
Figure 67A:
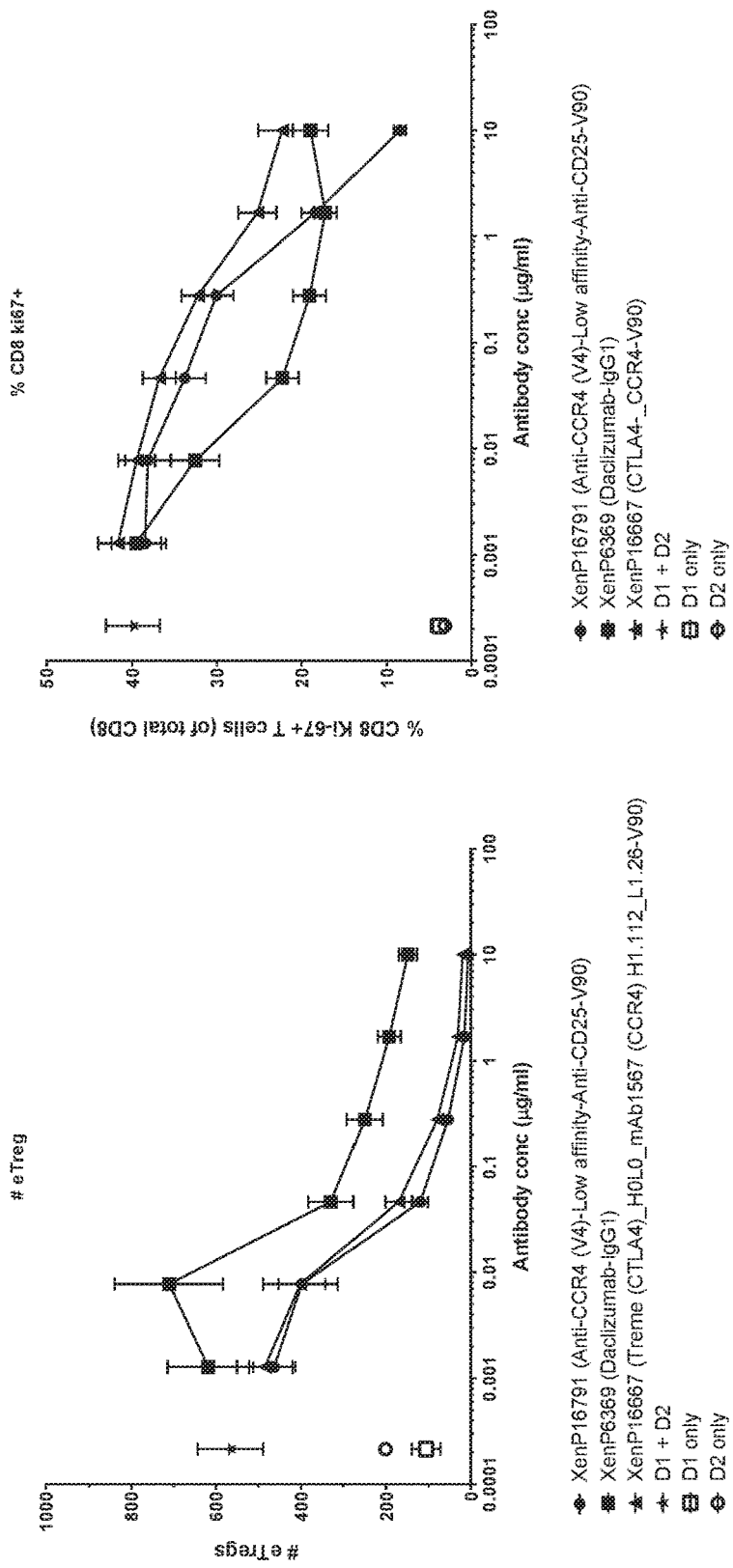
FIG. 67A-67C. Graph showing the deletion of Tregs in a single-dose multi-donor MLR assay using heterodimeric antibodies XENP16791, 16667, and 6369 described herein.
Figure 67B:
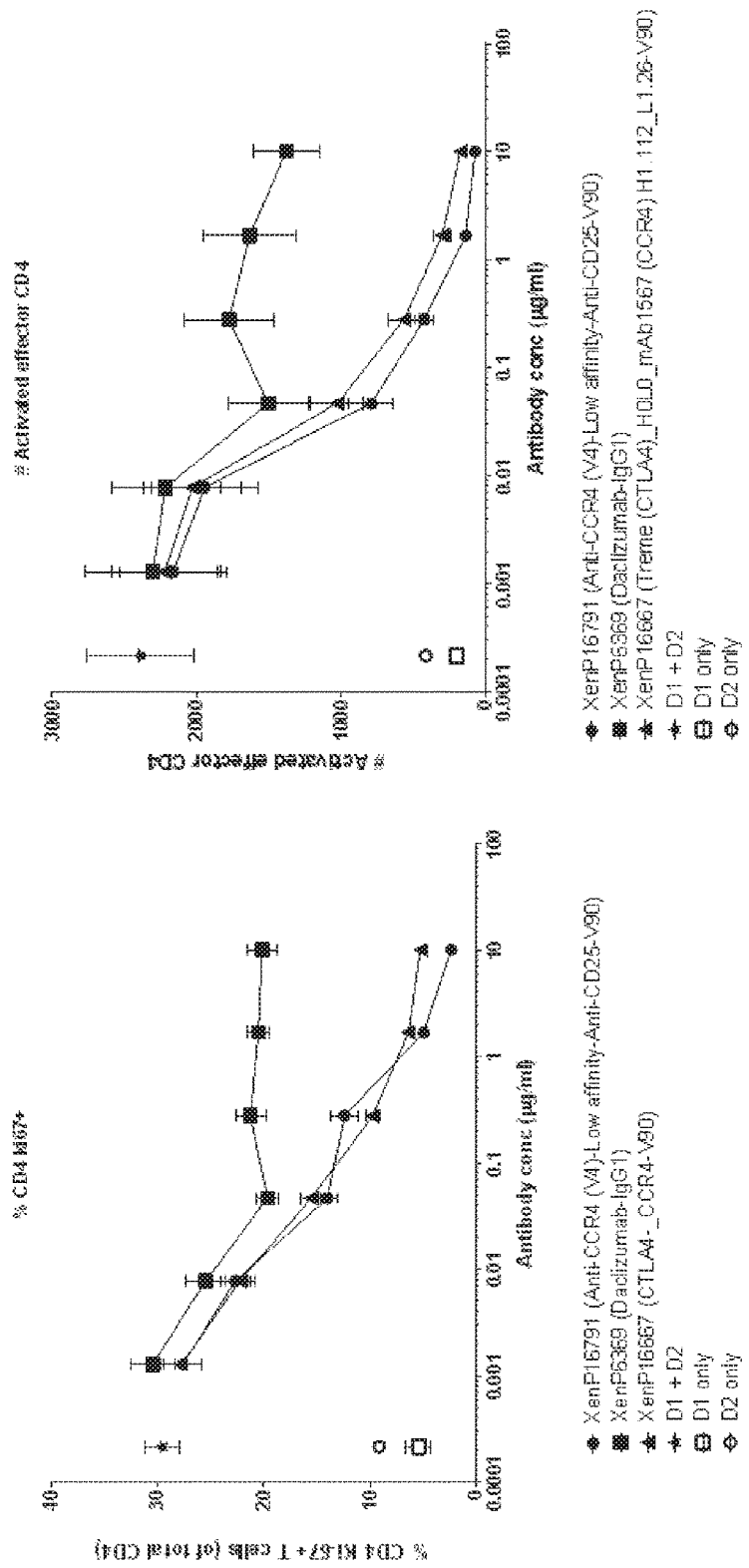
Figure 67C:
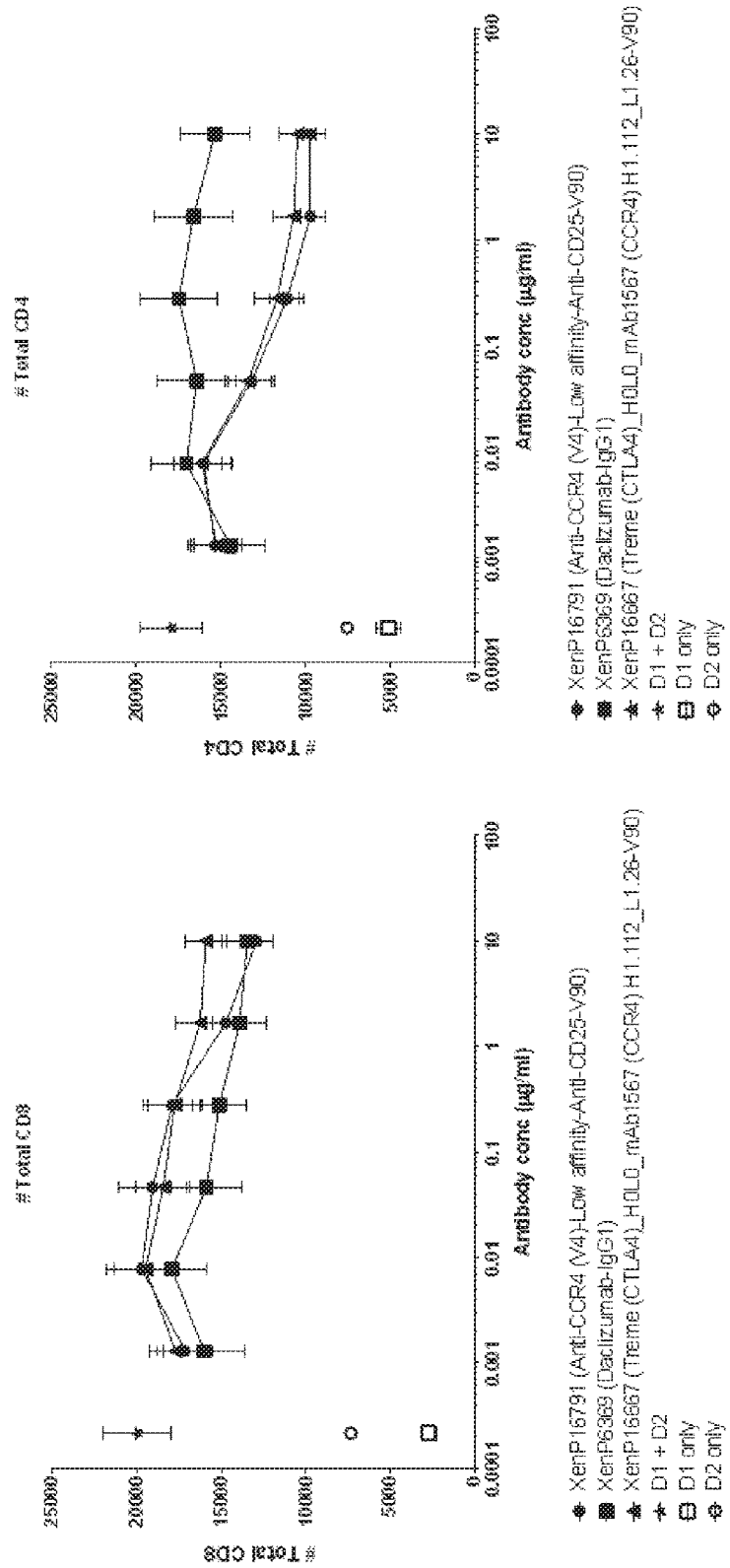

In addition to all or part of a variant heavy constant domain, one or both of the monomers may contain one or two fusion partners, such that the heterodimers form multivalent proteins. As is generally depicted in the FIG. 64 of U.S. Ser. No. 13/648,951, hereby incorporated by reference with its accompanying legend, the fusion partners are depicted as A, B, C and D, with all combinations possible. In general, A, B, C and D are selected such that the heterodimer is at least bispecific or bivalent in its ability to interact with additional proteins. In the context of the present "triple F" format, generally A and B are an scFv and a Fv (as will be appreciated, either monomer can contain the scFv and the other the Fv/Fab) and then optionally one or two additional fusion partners.

Furthermore, as outlined herein, additional amino acid variants may be introduced into the bispecific antibodies of the invention, to add additional functionalities. For example, amino acid changes within the Fc region can be added (either to one monomer or both) to facilitate increased ADCC or CDC (e.g. altered binding to Fcγ receptors); to allow or increase yield of the addition of toxins and drugs (e.g. for ADC), as well as to increase binding to FcRn and/or increase serum half-life of the resulting molecules. As is further described herein and as will be appreciated by those in the art, any and all of the variants outlined herein can be optionally and independently combined with other variants.

Similarly, another category of functional variants are "Fcγ ablation variants" or "Fc knock out (FcKO or KO) variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, particularly in the use of bispecific antibodies of the invention, it is generally desirable to ablate FcγRIIIa binding to eliminate or significantly reduce ADCC activity.

Antibodies

The present invention relates to the generation of multispecific antibodies, generally therapeutic antibodies. As is discussed below, the term "antibody" is used generally. Antibodies that find use in the present invention can take on a number of formats as described herein, including traditional antibodies as well as antibody derivatives, fragments and mimetics, described below. In general, the term "antibody" includes any polypeptide that includes at least one constant domain, including, but not limited to, CH1, CH2, CH3 and CL.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to the IgG class, which has several subclasses, including, but not limited to IgG1, IgG2, IgG3, and IgG4. Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the present invention covers pI engineering of IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning."

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

It should be noted that for the IgG sequences depicted herein start at the CH1 region, position 118; the variable regions are not included except as noted. For example, the first amino acid, while designated as position "1" in the sequence listing, corresponds to position 118 of the CH1 region, according to EU numbering.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or CK).

Another region of interest for additional substitutions, outlined below, is the Fc region. By "Fc" or "Fc region" or "Fc domain" as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

Accordingly, in some embodiments the present invention provides heterodimeric antibodies that rely on the use of two different heavy chain variant Fc domains that will self-assemble to form heterodimeric antibodies.

In some embodiments, the antibodies are full length. By "full length antibody" herein is meant the structure that constitutes the natural biological form of an antibody, including variable and constant regions, including one or more modifications as outlined herein, particularly in the Fc domains to allow either heterodimerization formation or the purification of heterodimers away from homodimers. A full length heterodimeric antibody is two heavy chains with different Fc domains and either two light chains or a common light chain.

Alternatively, the antibodies can include a variety of structures as are generally shown in the Figures, including, but not limited to, antibody fragments, monoclonal antibodies, bispecific antibodies, minibodies, domain antibodies, synthetic antibodies (sometimes referred to herein as "antibody mimetics"), chimeric antibodies, humanized antibodies, antibody fusions (sometimes referred to as "antibody conjugates"), and fragments of each, respectively.

In one embodiment, the antibody is an antibody fragment, as long as it contains at least one constant domain which can be engineered to produce heterodimers, such as pI engineering. Other antibody fragments that can be used include fragments that contain one or more of the CH1, CH2, CH3, hinge and CL domains of the invention that have been pI engineered. For example, Fc fusions are fusions of the Fc region (CH2 and CH3, optionally with the hinge region) fused to another protein. A number of Fc fusions are known the art and can be improved by the addition of the heterodimerization variants of the invention. In the present case, antibody fusions can be made comprising CH1; CH1, CH2 and CH3; CH2; CH3; CH2 and CH3; CH1 and CH3, any or all of which can be made optionally with the hinge region, utilizing any combination of heterodimerization variants described herein.

scFv Embodiments

In some embodiments of the present invention, one monomer comprises a heavy chain comprises a scFV linked to an Fc domain, and the other monomer comprises a heavy chain comprising a Fab linked to an Fc domain, e.g. a "typical" heavy chain, and a light chain. By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein. By "Fv" or "Fv fragment" or "Fv region" as used herein is meant a polypeptide that comprises the VL and VH domains of a single antibody.

Several of the heterodimeric antibody embodiments described herein rely on the use of one or more scFv domains, comprising the variable heavy and variable light chains, covalently linked using a linker, forming an antigen binding domain. Some embodiments herein use "standard" linkers, usually linkers of glycine and serine, as is well known in the art.

The present invention further provides charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

In addition, disulfide bonds can be engineered into the variable heavy and variable light chains to give additional stability.

Chimeric and Humanized Antibodies

In some embodiments, the antibody can be a mixture from different species, e.g. a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321:522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. No. 5,530,101; U.S. Pat. No. 5,585,089; U.S. Pat. No. 5,693,761; U.S. Pat. No. 5,693,762; U.S. Pat. No. 6,180,370; U.S. Pat. No. 5,859,205; U.S. Pat. No. 5,821,337; U.S. Pat. No. 6,054,297; U.S. Pat. No. 6,407,213, all entirely incorporated by reference). The humanized antibody optimally also will comprise at least a portion of an immunoglobulin constant region, typically that of a human immunoglobulin, and thus will typically comprise a human Fc region. Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

Heterodimeric Heavy Chain Constant Regions

Accordingly, the present invention provides heterodimeric proteins based on the use of monomers containing variant heavy chain constant regions, and specifically the Fc domains, as a first domain. By "monomer" herein is meant one half of the heterodimeric protein. It should be noted that traditional antibodies are actually tetrameric (two heavy chains and two light chains). In the context of the present invention, one pair of heavy-light chains (if applicable, e.g. if the monomer comprises an Fab) is considered a "monomer". Similarly, a heavy chain region comprising the scFv is considered a monomer. In the case where an Fv region is one fusion partner (e.g. heavy and light variable domains) and a non-antibody protein is another fusion partner, each "half" is considered a monomer. Essentially, each monomer comprises sufficient heavy chain constant region to allow heterodimerization engineering, whether that be all the constant region, e.g. Ch1-hinge-CH2-CH3, the Fc region (CH2-CH3), or just the CH3 domain.

The variant heavy chain constant regions can comprise all or part of the heavy chain constant region, including the full length construct, CH1-hinge-CH2-CH3, or portions thereof, including for example CH2-CH3 or CH3 alone. In addition, the heavy chain region of each monomer can be the same backbone (CH1-hinge-CH2-CH3 or CH2-CH3) or different. N- and C-terminal truncations and additions are also included within the definition; for example, some pI variants include the addition of charged amino acids to the C-terminus of the heavy chain domain.

Thus, in general, one monomer of the present "triple F" construct is a scFv region-hinge-Fc domain) and the other is (VH-CH1-hinge-CH2-CH3 plus associated light chain), with heterodimerization variants, including steric, isotypic, charge steering, and pI variants, Fc and FcRn variants, ablation variants, and additional antigen binding domains (with optional linkers) included in these regions.

In addition to the heterodimerization variants (e.g. steric and pI variants) outlined herein, the heavy chain regions may also contain additional amino acid substitutions, including changes for altering FcγR and FcRn binding as discussed below.

Figure 9:
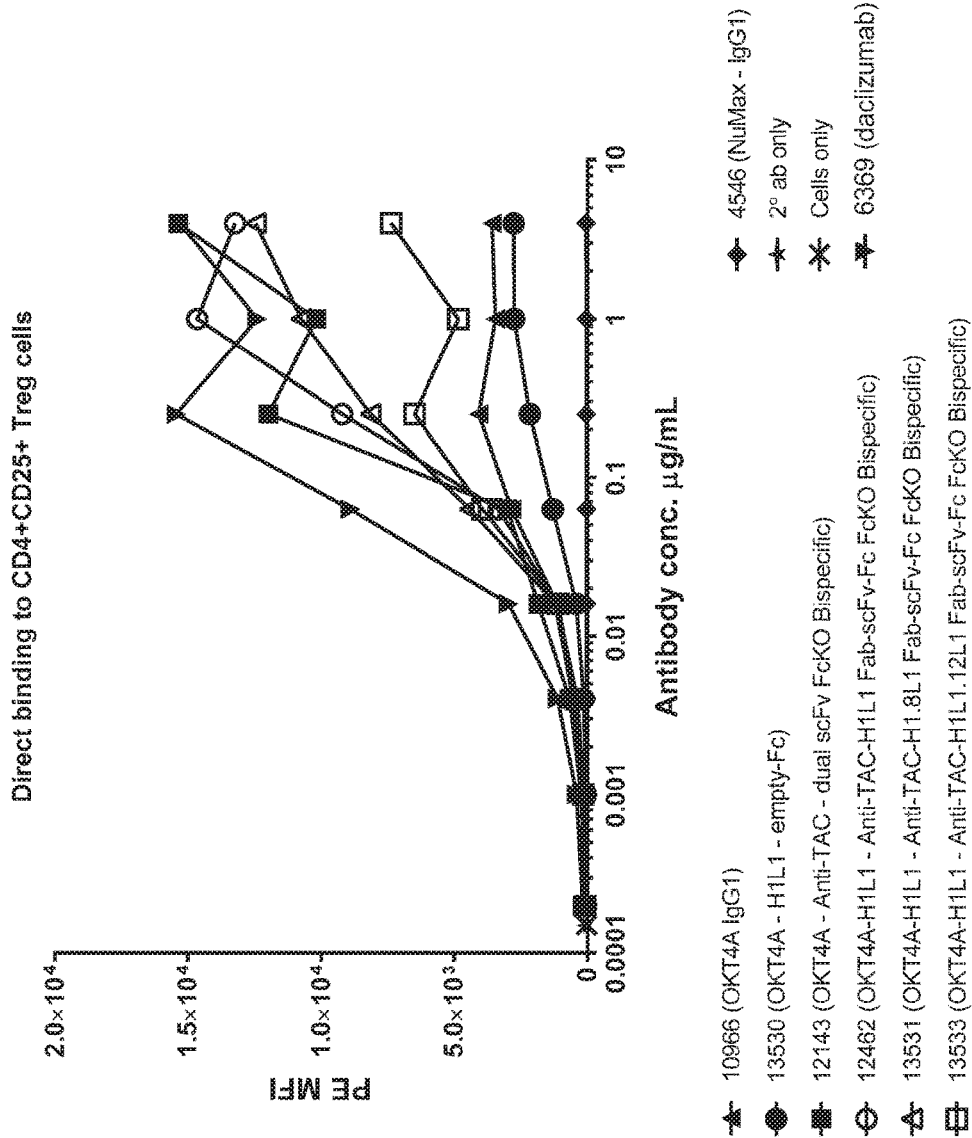
FIG. 9. Direct binding of anti-CD4× anti-CD25 bispecifics and control antibodies on Treg cells. Variants engineered for altered CD25 affinity are shown.

In addition, some monomers can utilize linkers between the variant heavy chain constant region and the fusion partner. For the scFv portion of the "bottle-opener", standard linkers as are known in the art can be used, or the charged scFv linkers described herein. In the case where additional fusion partners are made (e.g. FIGS. 1 and 2), traditional peptide linkers can be used, including flexible linkers of glycine and serine, or the charged linkers of FIG. 9. In some cases, the linkers for use as components of the monomer are different from those defined below for the ADC constructs, and are in many embodiments not cleavable linkers (such as those susceptible to proteases), although cleavable linkers may find use in some embodiments.

The heterodimerization variants include a number of different types of variants, including, but not limited to, steric variants (including charge variants) and pI variants, that can be optionally and independently combined with any other variants. In these embodiments, it is important to match "monomer A" with "monomer B"; that is, if a heterodimeric protein relies on both steric variants and pI variants, these need to be correctly matched to each monomer: e.g. the set of steric variants that work (1 set on monomer A, 1 set on monomer B) is combined with pI variant sets (1 set on monomer A, 1 set on monomer B), such that the variants on each monomer are designed to achieve the desired function, keeping in mind the pI "strandedness" such that steric variants that may alter pI are put on the appropriate monomer.

Figure 12:
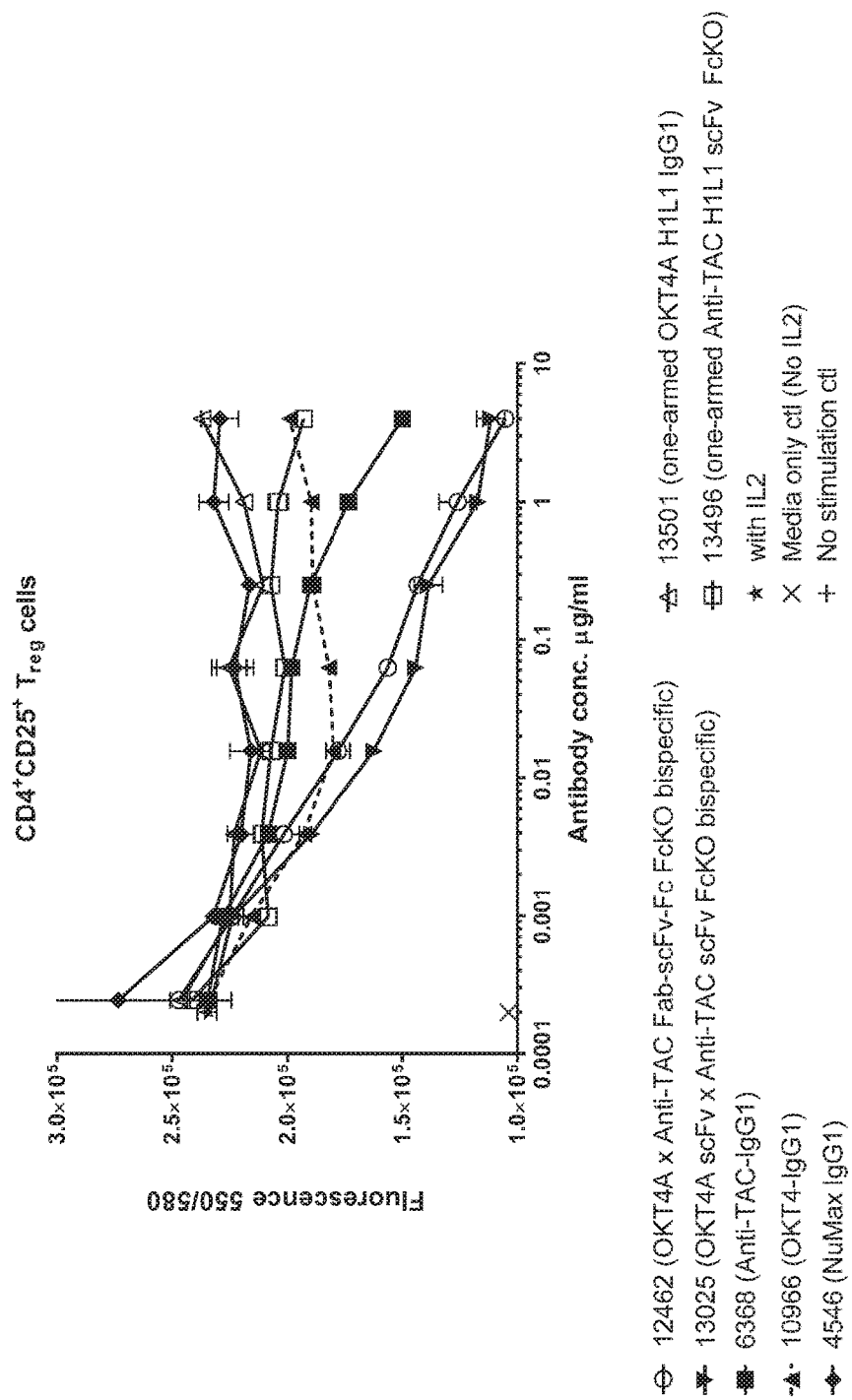
FIG. 12. Suppression of Treg cells by anti-CD4× anti-CD25 bispecifics. Proliferation of Tregs was assayed using CFSE in the presence of bispecific or control antibodies with 15 U/mL IL2.

It is important to note that the heterodimerization variants outlined herein (for example, including but not limited to those variants shown in FIGS. 3 and 12), can be optionally and independently combined with any other variants, and on any other monomer. That is, what is important for the heterodimerization is that there are "sets" of variants, one set for one monomer and one set for the other. Whether these are combined from the FIGS. 1 to 1 (e.g. monomer 1 listings can go together) or switched (monomer 1 pI variants with monomer 2 steric variants) is irrelevant. However, as noted herein, "strandedness" should be preserved when combinations are made as outlined above. Furthermore, for the additional Fc variants (such as for FcγR binding, FcRn binding, etc.), either monomer, or both monomers, can include any of the listed variants, independently and optionally. In some cases, both monomers have the additional variants and in some only one monomer has the additional variants, or they can be combined.

Heterodimerization Variants

The present invention provides heterodimeric proteins, including heterodimeric antibodies in a variety of formats, which utilize heterodimeric variants to allow for heterodimeric formation and/or purification away from homodimers.

Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in FIG. 41.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, the figure and legend and SEQ ID NOs of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Combinations of pI variants are shown in the figures.

Heavy Chain pI Changes

As outlined herein and shown in the figures, PI variants are shown relative to IgG1, but all isotypes can be altered this way, as well as isotype hybrids. In the case where the heavy chain constant domain is from IgG2-4, R133E and R133Q can also be used.

Antibody Heterodimers Light Chain Variants

In the case of antibody based heterodimers, e.g. where at least one of the monomers comprises a light chain in addition to the heavy chain domain, pI variants can also be made in the light chain. Amino acid substitutions for lowering the pI of the light chain include, but are not limited to, K126E, K126Q, K145E, K145Q, N152D, S156E, K169E, S202E, K207E and adding peptide DEDE at the c-terminus of the light chain. Changes in this category based on the constant lambda light chain include one or more substitutions at R108Q, Q124E, K126Q, N138D, K145T and Q199E. In addition, increasing the pI of the light chains can also be done.

Isotypic Variants

Figure 10:
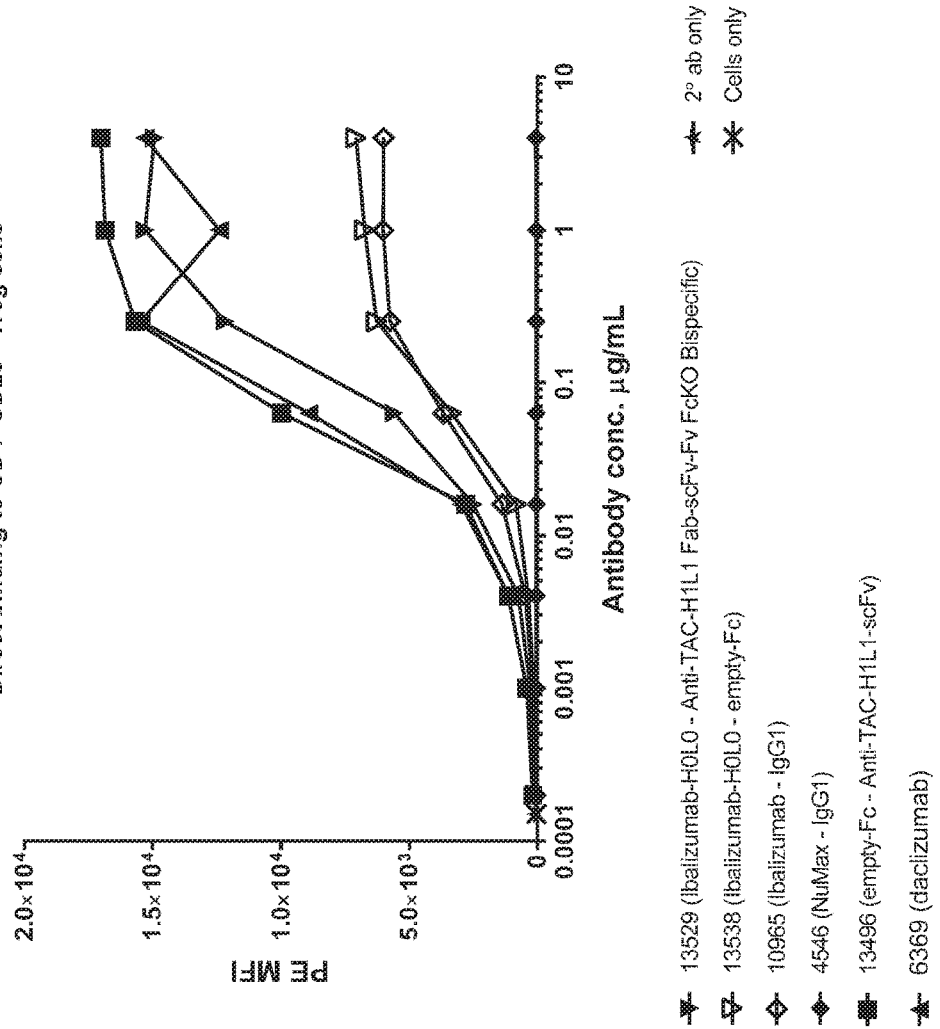
FIG. 10. Direct binding of anti-CD4× anti-CD25 bispecifics and control antibodies on Treg cells. Variants containing the ibalizumab anti-CD4 Fv are shown.
Figure 11:
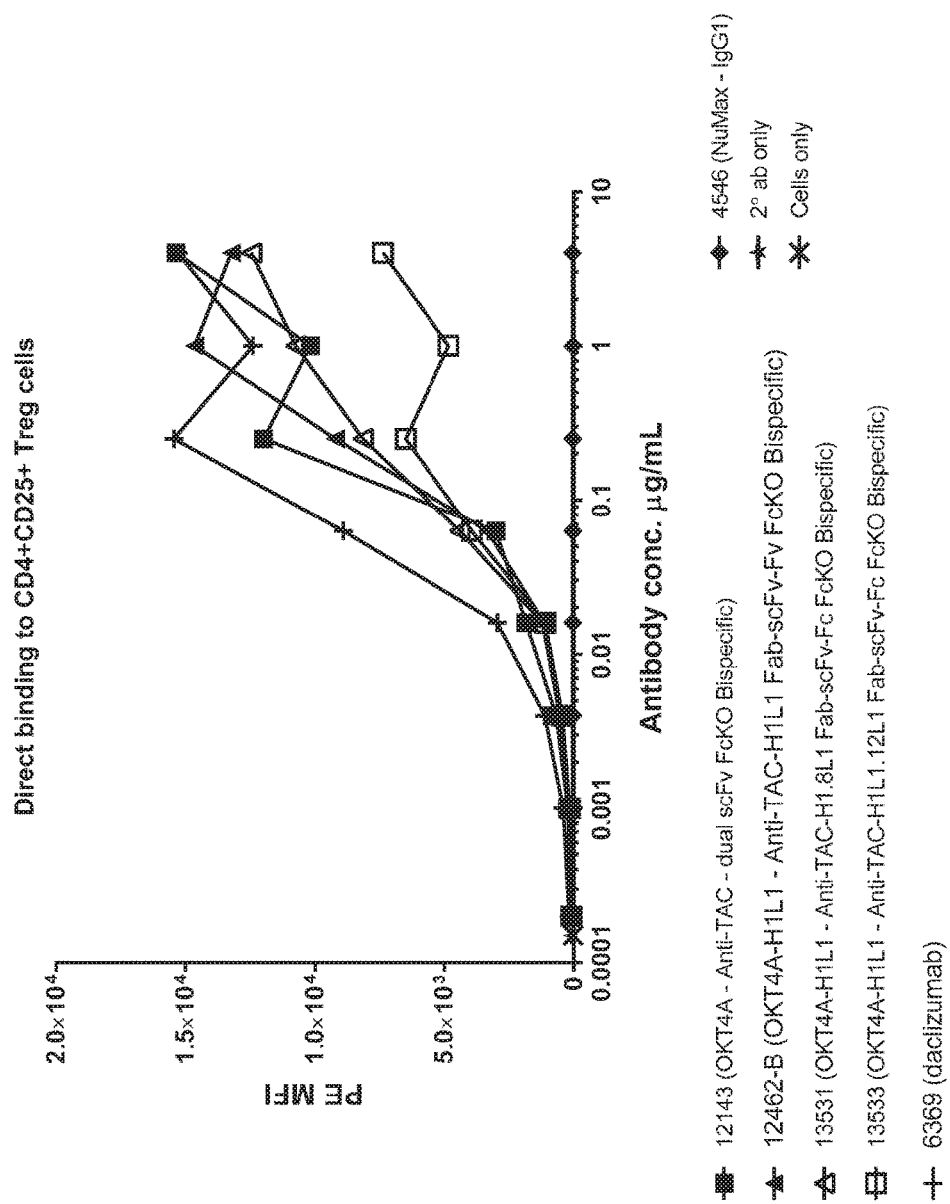
FIG. 11. Direct binding of anti-CD4× anti-CD25 bispecifics and control antibodies on Treg cells.

In addition, many embodiments of the invention rely on the "importation" of pI amino acids at particular positions from one IgG isotype into another, thus reducing or eliminating the possibility of unwanted immunogenicity being introduced into the variants. A number of these are shown in FIGS. 10A and 10B. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in FIG. 53. As discussed herein, which monomer to engineer is generally decided by the inherent pI of the Fv and scaffold regions. Alternatively, the pI of each monomer can be compared.

Heterodimeric Fc Fusion Proteins

In addition to heterodimeric antibodies, the invention provides heterodimeric proteins that comprise a first monomer comprising a variant Fc region and a first fusion partner and a second monomer, also comprising a variant Fc region and a second fusion partner. The variant Fc regions are engineered as herein for antibodies, and are thus different, and in general the first and second fusion partners are different as well. In some cases, where one monomer is antibody based (e.g. either comprising a standard heavy and light chain or a Fc domain with an scFv) and the other is an Fc fusion protein, the resulting heterodimeric protein is called a "fusionbody".

pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Figure 20:
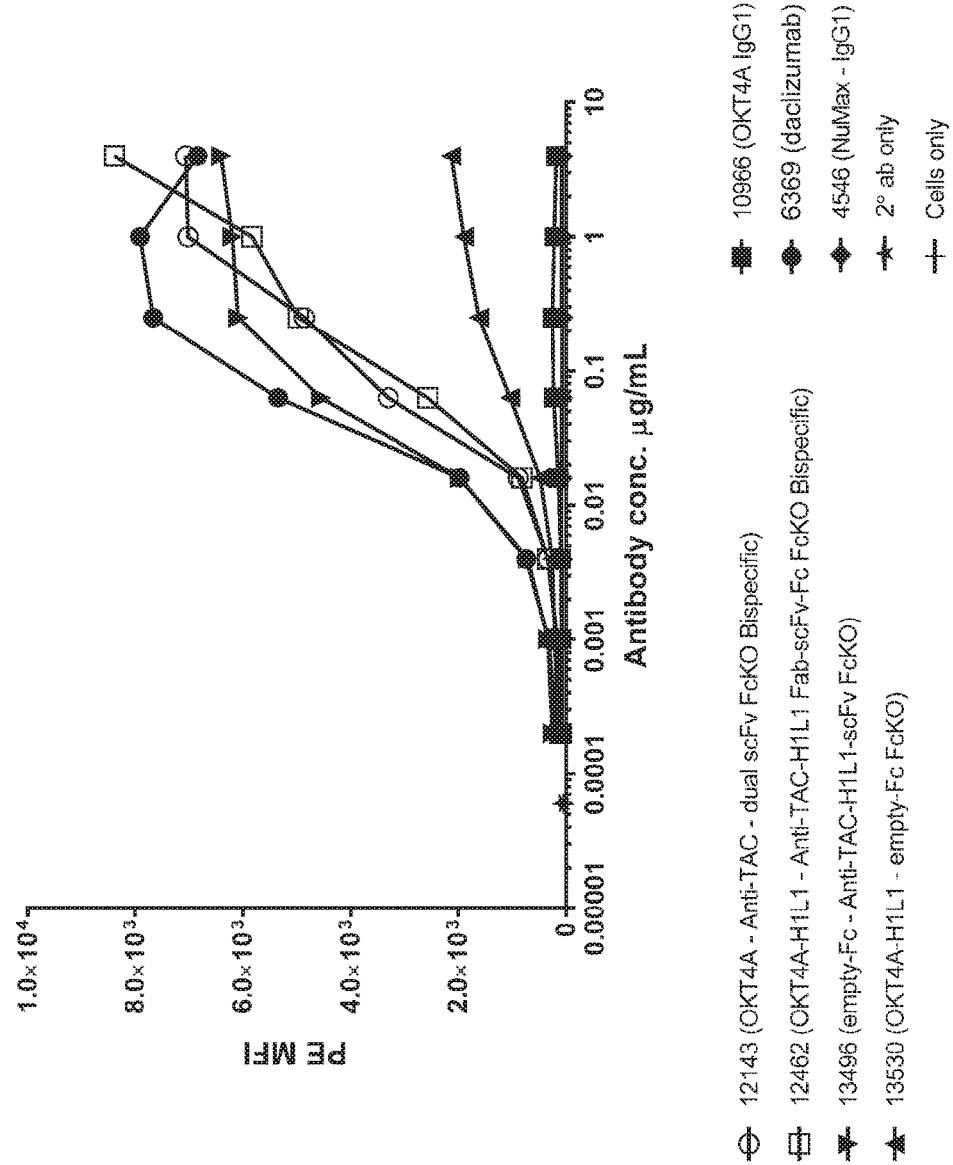
FIG. 20. Direct binding of anti-CD4× anti-CD25 bispecifics and controls to activated T effector cells (CD8+CD25+).
Figure 21:
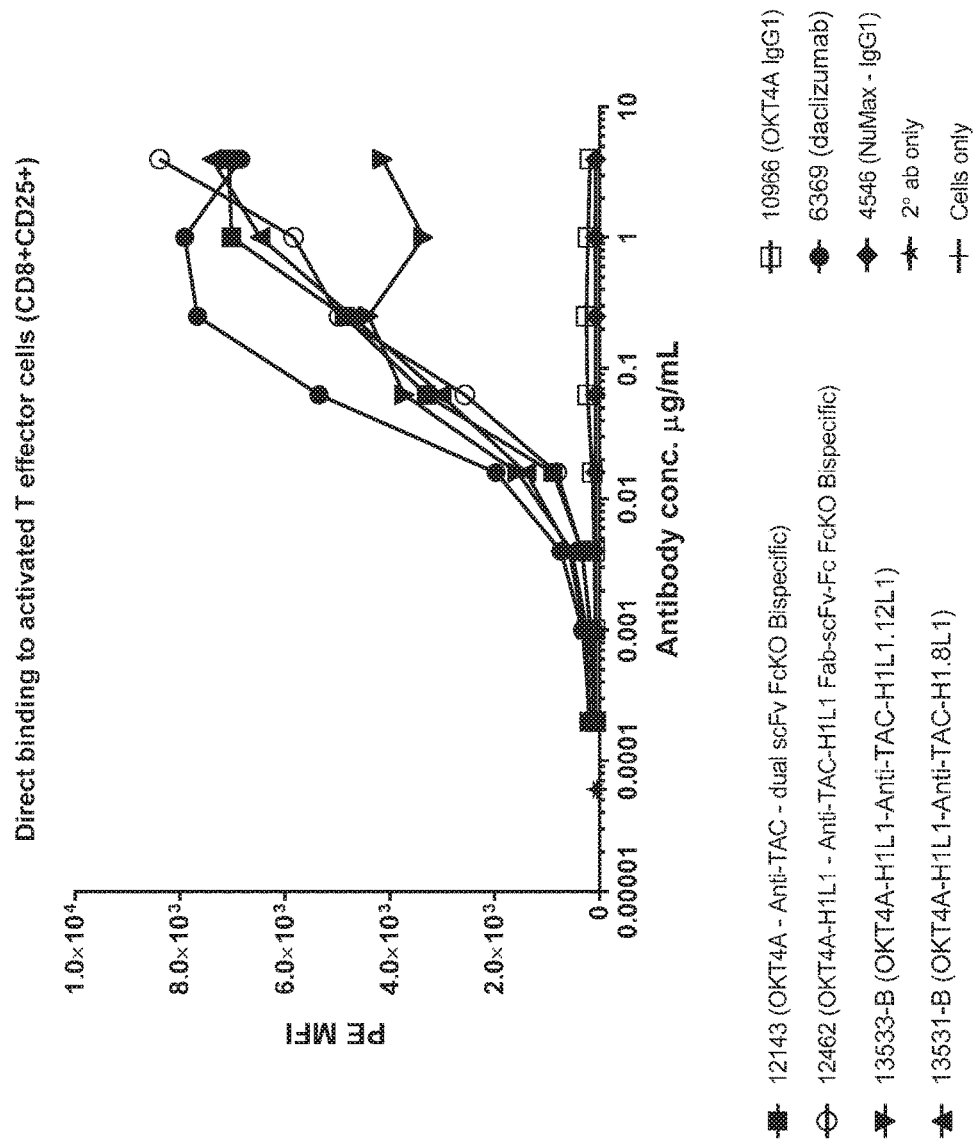
FIG. 21. Direct binding of altered CD25 affinity anti-CD4× anti-CD25 bispecifics to activated T effector cells (CD8+CD25+).
Figure 22:
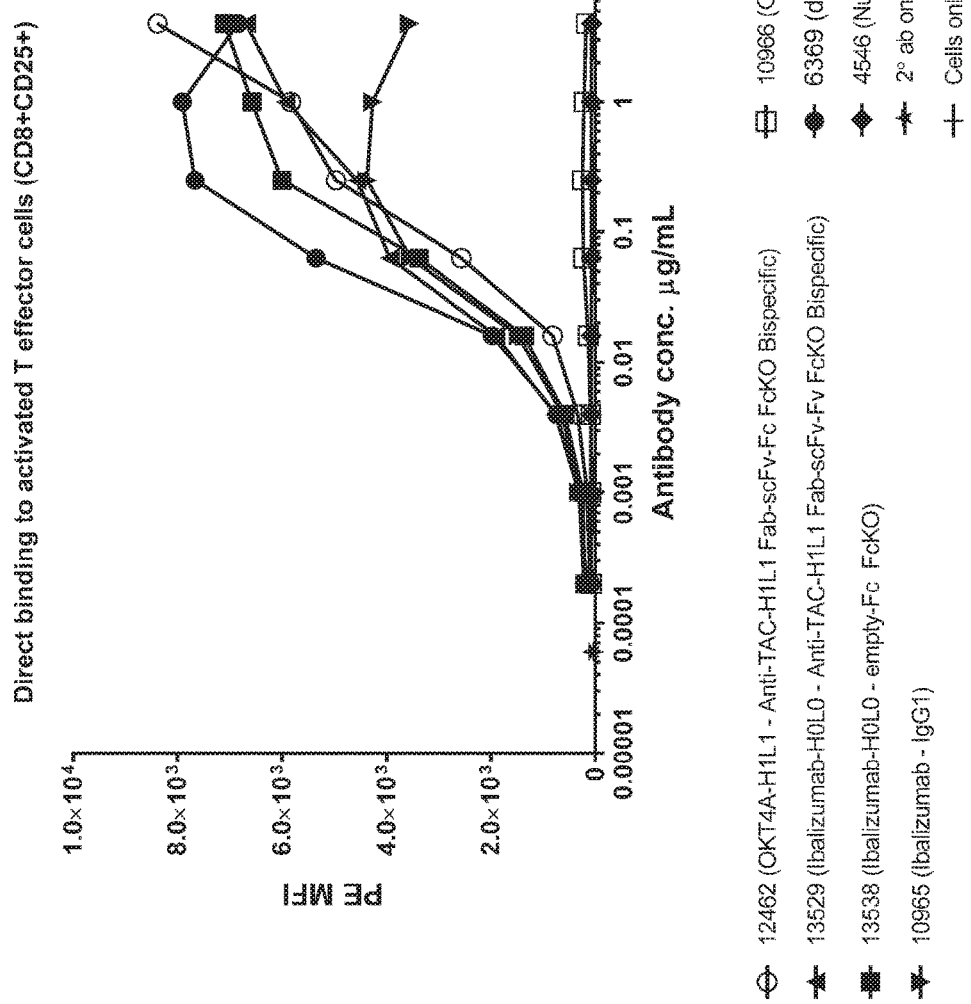
FIG. 22. Direct binding of anti-CD4× anti-CD25 bispecifics and controls to activated T effector cells (CD8+CD25+).

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

pI variants that find use in this embodiment, as well as their use for purification optimization, are disclosed in FIG. 20.

Combination of Heterodimeric Variants

As will be appreciated by those in the art, all of the recited heterodimerization variants can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

Nucleic Acids

As discussed above regarding methods of making compositions of the present invention, the invention further provides nucleic acid compositions encoding the heterodimeric proteins of the invention. As will be appreciated by those in the art, the nucleic acid compositions will depend on the format and scaffold of the heterodimeric protein. Thus, for example, when the format requires three amino acid sequences, such as for the triple F format (e.g. a first amino acid monomer comprising an Fc domain and a scFv, a second amino acid monomer comprising a heavy chain and a light chain), three nucleic acid sequences can be incorporated into one or more expression vectors for expression. Similarly, some formats (e.g. dual scFv formats such as disclosed in FIG. 36M) only two nucleic acids are needed; again, they can be put into one or two expression vectors.

Target Antigens

The heterodimeric proteins of the invention may target virtually any antigens. The "triple F" format is particularly beneficial for targeting two (or more) distinct antigens. (As outlined herein, this targeting can be any combination of monovalent and divalent binding, depending on the format). Thus the immunoglobulins herein preferably co-engage two target antigens, although in some cases, three or four antigens can be monovalently engaged. Each monomer's specificity can be selected from the lists below. While the triple F immunoglobulins described herein are particularly beneficial for targeting distinct antigens, in some cases it may be beneficial to target only one antigen. That is, each monomer may have specificity for the same antigen.

Particular suitable applications of the heterodimeric proteins herein are co-target pairs for which it is beneficial or critical to engage each target antigen monovalently. Such antigens may be, for example, immune receptors that are activated upon immune complexation. Cellular activation of many immune receptors occurs only by cross-linking, achieved typically by antibody/antigen immune complexes, or via effector cell to target cell engagement. For some immune receptors, activation only upon engagement with co-engaged target is critical, as nonspecific cross-linking in a clinical setting can elicit a cytokine storm and toxicity. Therapeutically, by engaging such antigens monovalently rather than multivalently, using the immunoglobulins herein, such activation occurs only in response to cross-linking only in the microenvironment of the primary target antigen. The ability to target two different antigens with different valencies is a novel and useful aspect of the present invention. Examples of target antigens for which it may be therapeutically beneficial or necessary to co-engage monovalently include but are not limited to immune activating receptors such as CD3, FcγRs, toll-like receptors (TLRs) such as TLR4 and TLR9, cytokine, chemokine, cytokine receptors, and chemokine receptors. In many embodiments, one of the antigen binding sites binds to CD3, and in some embodiments it is the scFv-containing monomer.

Virtually any antigen may be targeted by the immunoglobulins herein, including but not limited to proteins, subunits, domains, motifs, and/or epitopes belonging to the following list of target antigens, which includes both soluble factors such as cytokines and membrane-bound factors, including transmembrane receptors: 17-IA, 4-1BB, 4Dc, 6-keto-PGF1a, 8-iso-PGF2a, 8-oxo-dG, A1 Adenosine Receptor, A33, ACE, ACE-2, Activin, Activin A, Activin AB, Activin B, Activin C, Activin RIA, Activin RIA ALK-2, Activin RIB ALK-4, Activin RIIA, Activin RIIB, ADAM, ADAM10, ADAM12, ADAM15, ADAM17/TACE, ADAM8, ADAM9, ADAMTS, ADAMTS4, ADAMTS5, Addressins, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, Artemin, anti-Id, ASPARTIC, Atrial natriuretic factor, av/b3 integrin, Axl, b2M, B7-1, B7-2, B7-H, B-lymphocyte Stimulator (BlyS), BACE, BACE-1, Bad, BAFF, BAFF-R, Bag-1, BAK, Bax, BCA-1, BCAM, Bcl, BCMA, BDNF, b-ECGF, bFGF, BID, Bik, BIM, BLC, BL-CAM, BLK, BMP, BMP-2 BMP-2a, BMP-3 Osteogenin, BMP-4 BMP-2b, BMP-5, BMP-6 Vgr-1, BMP-7 (OP-1), BMP-8 (BMP-8a, OP-2), BMPR, BMPR-IA (ALK-3), BMPR-IB (ALK-6), BRK-2, RPK-1, BMPR-II (BRK-3), BMPs, b-NGF, BOK, Bombesin, Bone-derived neurotrophic factor, BPDE, BPDE-DNA, BTC, complement factor 3 (C3), C3a, C4, C5, C5a, C10, CA125, CAD-8, Calcitonin, cAMP, carcinoembryonic antigen (CEA), carcinoma-associated antigen, Cathepsin A, Cathepsin B, Cathepsin C/DPPI, Cathepsin D, Cathepsin E, Cathepsin H, Cathepsin L, Cathepsin O, Cathepsin S, Cathepsin V, Cathepsin X/Z/P, CBL, CCI, CCK2, CCL, CCL1, CCL11, CCL12, CCL13, CCL14, CCL15, CCL16, CCL17, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR10, CCR2, CCR3, CCR4, CCR5, CCR6, CCR7, CCR8, CCR9, CD1, CD2, CD3, CD3E, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 proteins), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD148, CD152, CD164, CEACAM5, CFTR, cGMP, CINC, Clostridium botulinum toxin, Clostridium perfringens toxin, CKb8-1, CLC, CMV, CMV UL, CNTF, CNTN-1, COX, C-Ret, CRG-2, CT-1, CTACK, CTGF, CTLA-4, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor-associated antigen, DAN, DCC, DcR3, DC-SIGN, Decay accelerating factor, des(1-3)-IGF-I (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, ENA, endothelin receptor, Enkephalinase, eNOS, Eot, eotaxin1, EpCAM, Ephrin B2/EphB4, EPO, ERCC, E-selectin, ET-1, Factor IIa, Factor VII, Factor Milo, Factor IX, fibroblast activation protein (FAP), Fas, FcR1, FEN-1, Ferritin, FGF, FGF-19, FGF-2, FGF3, FGF-8, FGFR, FGFR-3, Fibrin, FL, FLIP, Flt-3, Flt-4, Follicle stimulating hormone, Fractalkine, FZD1, FZD2, FZD3, FZD4, FZD5, FZD6, FZD7, FZD8, FZD9, FZD10, G250, Gas 6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF-8 (Myostatin), GDF-9, GDF-15 (MIC-1), GDNF, GDNF, GFAP, GFRa-1, GFR-alpha1, GFR-alpha2, GFR-alpha3, GITR, Glucagon, Glut 4, glycoprotein IIb/IIIa (GP IIb/IIIa), GM-CSF, gp130, gp72, GRO, Growth hormone releasing factor, Hapten (NP-cap or NIP-cap), HB-EGF, HCC, HCMV gB envelope glycoprotein, HCMV) gH envelope glycoprotein, HCMV UL, Hemopoietic growth factor (HGF), Hep B gp120, heparanase, Her2, Her2/neu (ErbB-2), Her3 (ErbB-3), Her4 (ErbB-4), herpes simplex virus (HSV) gB glycoprotein, HSV gD glycoprotein, HGFA, High molecular weight melanoma-associated antigen (HMW-MAA), HIV gp120, HIV IIIB gp 120 V3 loop, HLA, HLA-DR, HM1.24, HMFG PEM, HRG, Hrk, human cardiac myosin, human cytomegalovirus (HCMV), human growth hormone (HGH), HVEM, I-309, IAP, ICAM, ICAM-1, ICAM-3, ICE, ICOS, IFNg, Ig, IgA receptor, IgE, IGF, IGF binding proteins, IGF-1R, IGFBP, IGF-I, IGF-II, IL, IL-1, IL-1R, IL-2, IL-2R, IL-4, IL-4R, IL-5, IL-5R, IL-6, IL-6R, IL-8, IL-9, IL-10, IL-12, IL-13, IL-15, IL-18, IL-18R, IL-23, interferon (INF)-alpha, INF-beta, INF-gamma, Inhibin, iNOS, Insulin A-chain, Insulin B-chain, Insulin-like growth factor 1, integrin alpha2, integrin alpha3, integrin alpha4, integrin alpha4/beta1, integrin alpha4/beta7, integrin alpha5 (alphaV), integrin alpha5/beta1, integrin alpha5/beta3, integrin alpha6, integrin beta1, integrin beta2, interferon gamma, IP-10, I-TAC, JE, Kallikrein 2, Kallikrein 5, Kallikrein 6 Kallikrein 11, Kallikrein 12, Kallikrein 14, Kallikrein 15, Kallikrein L1, Kallikrein L2, Kallikrein L3, Kallikrein L4, KC, KDR, Keratinocyte Growth Factor (KGF), laminin 5, LAMP, LAP, LAP (TGF-1), Latent TGF-1, Latent TGF-1 bp1, LBP, LDGF, LECT2, Lefty, Lewis-Y antigen, Lewis-Y related antigen, LFA-1, LFA-3, Lfo, LIF, LIGHT, lipoproteins, LIX, LKN, Lptn, L-Selectin, LT-a, LT-b, LTB4, LTBP-1, Lung surfactant, Luteinizing hormone, Lymphotoxin Beta Receptor, Mac-1, MAdCAM, MAG, MAP2, MARC, MCAM, MCAM, MCK-2, MCP, M-CSF, MDC, Mer, METALLOPROTEASES, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Mud), MUC18, Muellerian-inhibitin substance, Mug, MuSK, NAIP, NAP, NCAD, N-Cadherin, NCA 90, NCAM, NCAM, Neprilysin, Neurotrophin-3, -4, or -6, Neurturin, Neuronal growth factor (NGF), NGFR, NGF-beta, nNOS, NO, NOS, Npn, NRG-3, NT, NTN, OB, OGG1, OPG, OPN, OSM, OX40L, OX40R, p150, p95, PADPr, Parathyroid hormone, PARC, PARP, PBR, PBSF, PCAD, P-Cadherin, PCNA, PDGF, PDGF, PDK-1, PECAM, PEM, PF4, PGE, PGF, PGI2, PGJ2, PIN, PLA2, placental alkaline phosphatase (PLAP), PIGF, PLP, PP14, Proinsulin, Prorelaxin, Protein C, PS, PSA, PSCA, prostate specific membrane antigen (PSMA), PTEN, PTHrp, Ptk, PTN, R51, RANK, RANKL, RANTES, RANTES, Relaxin A-chain, Relaxin B-chain, renin, respiratory syncytial virus (RSV) F, RSV Fgp, Ret, Rheumatoid factors, RLIP76, RPA2, RSK, S100, SCF/KL, SDF-1, SERINE, Serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T-cell receptors (e.g., T-cell receptor alpha/beta), TdT, TECK, TEM1, TEM5, TEM7, TEM8, TERT, testicular PLAP-like alkaline phosphatase, TfR, TGF, TGF-alpha, TGF-beta, TGF-beta Pan Specific, TGF-beta RI (ALK-5), TGF-beta RII, TGF-beta RIIb, TGF-beta RIII, TGF-beta1, TGF-beta2, TGF-beta3, TGF-beta4, TGF-beta5, Thrombin, Thymus Ck-1, Thyroid stimulating hormone, Tie, TIMP, TIQ, Tissue Factor, TMEFF2, Tmpo, TMPRSS2, TNF, TNF-alpha, TNF-alpha beta, TNF-beta2, TNFc, TNF-RI, TNF-RII, TNFRSF10A (TRAIL R1 Apo-2, DR4), TNFRSF10B (TRAIL R2 DR5, KILLER, TRICK-2A, TRICK-B), TNFRSF10C (TRAIL R3 DcR1, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSF1A (TNF RI CD120a, p55-60), TNFRSF1B (TNF RII CD120b, p75-80), TNFRSF26 (TNFRH3), TNFRSF3 (LTbR TNF RIII, TNFC R), TNFRSF4 (OX40 ACT35, TXGP1 R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (DcTRAIL R1 TNFRH1), TNFRSF25 (DR3 Apo-3, LARD, TR-3, TRAMP, WSL-1), TNFSF10 (TRAIL Apo-2 Ligand, TL2), TNFSF11 (TRANCE/RANK Ligand ODF, OPG Ligand), TNFSF12 (TWEAK Apo-3 Ligand, DR3 Ligand), TNFSF13 (APRIL TALL2), TNFSF13B (BAFF BLYS, TALL1, THANK, TNFSF20), TNFSF14 (LIGHT HVEM Ligand, LTg), TNFSF15 (TL1A/VEGI), TNFSF18 (GITR Ligand AITR Ligand, TL6), TNFSF1A (TNF-a Conectin, DIF, TNFSF2), TNFSF1B (TNF-b LTa, TNFSF1), TNFSF3 (LTb TNFC, p33), TNFSF4 (OX40 Ligand gp34, TXGP1), TNFSF5 (CD40 Ligand CD154, gp39, HIGM1, IMD3, TRAP), TNFSF6 (Fas Ligand Apo-1 Ligand, APT1 Ligand), TNFSF7 (CD27 Ligand CD70), TNFSF8 (CD30 Ligand CD153), TNFSF9 (4-1BB Ligand CD137 Ligand), TP-1, t-PA, Tpo, TRAIL, TRAIL R, TRAIL-R1, TRAIL-R2, TRANCE, transferring receptor, TRF, Trk, TROP-2, TSG, TSLP, tumor-associated antigen CA 125, tumor-associated antigen expressing Lewis Y related carbohydrate, TWEAK, TXB2, Ung, uPAR, uPAR-1, Urokinase, VCAM, VCAM-1, VECAD, VE-Cadherin, VE-cadherin-2, VEFGR-1 (flt-1), VEGF, VEGFR, VEGFR-3 (flt-4), VEGI, VIM, Viral antigens, VLA, VLA-1, VLA-4, VNR integrin, von Willebrands factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9A, WNT9B, WNT10A, WNT10B, WNT11, WNT16, XCL1, XCL2, XCR1, XCR1, XEDAR, XIAP, XPD, and receptors for hormones and growth factors. To form the bispecific or trispecific antibodies of the invention, antibodies to any combination of these antigens can be made; that is, each of these antigens can be optionally and independently included or excluded from a multispecific antibody according to the present invention.

Exemplary antigens that may be targeted specifically by the immunoglobulins of the invention include but are not limited to: CD20, CD19, Her2, EGFR, EpCAM, CD3, FcγRIIIa (CD16), FcγRIIa (CD32a), FcγRIIb (CD32b), FcγRI (CD64), Toll-like receptors (TLRs) such as TLR4 and TLR9, cytokines such as IL-2, IL-5, IL-13, IL-12, IL-23, and TNFα, cytokine receptors such as IL-2R, chemokines, chemokine receptors, growth factors such as VEGF and HGF, and the like. To form the multispecific antibodies of the invention, antibodies to any combination of these antigens can be made; that is, each of these antigens can be optionally and independently included or excluded from a multispecific antibody according to the present invention.

The choice of suitable target antigens and co-targets depends on the desired therapeutic application. Some targets that have proven especially amenable to antibody therapy are those with signaling functions. Other therapeutic antibodies exert their effects by blocking signaling of the receptor by inhibiting the binding between a receptor and its cognate ligand. Another mechanism of action of therapeutic antibodies is to cause receptor down regulation. Other antibodies do not work by signaling through their target antigen. The choice of co-targets will depend on the detailed biology underlying the pathology of the indication that is being treated.

Monoclonal antibody therapy has emerged as an important therapeutic modality for cancer (Weiner et al., 2010, Nature Reviews Immunology 10:317-327; Reichert et al., 2005, Nature Biotechnology 23[9]:1073-1078; herein expressly incorporated by reference). For anti-cancer treatment it may be desirable to target one antigen (antigen-1) whose expression is restricted to the cancerous cells while co-targeting a second antigen (antigen-2) that mediates some immunological killing activity. For other treatments, it may be beneficial to co-target two antigens, for example two angiogenic factors or two growth factors, that are each known to play some role in proliferation of the tumor. Exemplary co-targets for oncology include but are not limited to HGF and VEGF, IGF-1R and VEGF, Her2 and VEGF, CD19 and CD3, CD20 and CD3, Her2 and CD3, CD19 and FcγRIIIa, CD20 and FcγRIIIa, Her2 and FcγRIIIa. An immunoglobulin of the invention may be capable of binding VEGF and phosphatidylserine; VEGF and ErbB3; VEGF and PLGF; VEGF and ROBO4; VEGF and BSG2; VEGF and CDCP1; VEGF and ANPEP; VEGF and c-MET; HER-2 and ERB3; HER-2 and BSG2; HER-2 and CDCP1; HER-2 and ANPEP; EGFR and CD64; EGFR and BSG2; EGFR and CDCP1; EGFR and ANPEP; IGF1R and PDGFR; IGF1R and VEGF; IGF1R and CD20; CD20 and CD74; CD20 and CD30; CD20 and DR4; CD20 and VEGFR2; CD20 and CD52; CD20 and CD4; HGF and c-MET; HGF and NRP1; HGF and phosphatidylserine; ErbB3 and IGF1R; ErbB3 and IGF1,2; c-Met and Her-2; c-Met and NRP1; c-Met and IGF1R; IGF1,2 and PDGFR; IGF1,2 and CD20; IGF1,2 and IGF1R; IGF2 and EGFR; IGF2 and HER2; IGF2 and CD20; IGF2 and VEGF; IGF2 and IGF1R; IGF1 and IGF2; PDGFRa and VEGFR2; PDGFRa and PLGF; PDGFRa and VEGF; PDGFRa and c-Met; PDGFRa and EGFR; PDGFRb and VEGFR2; PDGFRb and c-Met; PDGFRb and EGFR; RON and c-Met; RON and MTSP1; RON and MSP; RON and CDCP1; VGFR1 and PLGF; VGFR1 and RON; VGFR1 and EGFR; VEGFR2 and PLGF; VEGFR2 and NRP1; VEGFR2 and RON; VEGFR2 and DLL4; VEGFR2 and EGFR; VEGFR2 and ROBO4; VEGFR2 and CD55; LPA and SIP; EPHB2 and RON; CTLA4 and VEGF; CD3 and EPCAM; CD40 and IL6; CD40 and IGF; CD40 and CD56; CD40 and CD70; CD40 and VEGFR1; CD40 and DR5; CD40 and DR4; CD40 and APRIL; CD40 and BCMA; CD40 and RANKL; CD28 and MAPG; CD80 and CD40; CD80 and CD30; CD80 and CD33; CD80 and CD74; CD80 and CD2; CD80 and CD3; CD80 and CD19; CD80 and CD4; CD80 and CD52; CD80 and VEGF; CD80 and DR5; CD80 and VEGFR2; CD22 and CD20; CD22 and CD80; CD22 and CD40; CD22 and CD23; CD22 and CD33; CD22 and CD74; CD22 and CD19; CD22 and DR5; CD22 and DR5; CD22 and VEGF; CD22 and CD52; CD30 and CD20; CD30 and CD22; CD30 and CD23; CD30 and CD40; CD30 and VEGF; CD30 and CD74; CD30 and CD19; CD30 and DR5; CD30 and DR4; CD30 and VEGFR2; CD30 and CD52; CD30 and CD4; CD138 and RANKL; CD33 and FTL3; CD33 and VEGF; CD33 and VEGFR2; CD33 and CD44; CD33 and DR4; CD33 and DR5; DR4 and CD137; DR4 and IGF1,2; DR4 and IGF1R; DR4 and DR5; DR5 and CD40; DR5 and CD137; DR5 and CD20; DR5 and EGFR; DR5 and IGF1,2; DR5 and IGFR, DR5 and HER-2, and EGFR and DLL4. Other target combinations include one or more members of the EGF/erb-2/erb-3 family.

Other targets (one or more) involved in oncological diseases that the immunoglobulins herein may bind include, but are not limited to those selected from the group consisting of: CD52, CD20, CD19, CD3, CD4, CD8, BMP6, IL12A, IL1A, IL1B, IL2, IL24, INHA, TNF, TNFSF10, BMP6, EGF, FGF1, FGF10, FGF11, FGF12, FGF13, FGF14, FGF16, FGF17, FGF18, FGF19, FGF2, FGF20, FGF21, FGF22, FGF23, FGF3, FGF4, FGF5, FGF6, FGF7, FGF8, FGF9, GRP, IGF1, IGF2, IL12A, IL1A, IL1B, IL2, INHA, TGFA, TGFB1, TGFB2, TGFB3, VEGF, CDK2, FGF10, FGF18, FGF2, FGF4, FGF7, IGF1R, IL2, BCL2, CD164, CDKN1A, CDKN1B, CDKN1C, CDKN2A, CDKN2B, CDKN2C, CDKN3, GNRH1, IGFBP6, IL1A, IL1B, ODZ1, PAWR, PLG, TGFB1I1, AR, BRCA1, CDK3, CDK4, CDK5, CDK6, CDK7, CDK9, E2F1, EGFR, ENO1, ERBB2, ESR1, ESR2, IGFBP3, IGFBP6, IL2, INSL4, MYC, NOX5, NR6A1, PAP, PCNA, PRKCQ, PRKD1, PRL, TP53, FGF22, FGF23, FGF9, IGFBP3, IL2, INHA, KLK6, TP53, CHGB, GNRH1, IGF1, IGF2, INHA, INSL3, INSL4, PRL, KLK6, SHBG, NR1D1, NR1H3, NR1I3, NR2F6, NR4A3, ESR1, ESR2, NR0B1, NR0B2, NR1D2, NR1H2, NR1H4, NR1I2, NR2C1, NR2C2, NR2E1, NR2E3, NR2F1, NR2F2, NR3C1, NR3C2, NR4A1, NR4A2, NR5A1, NR5A2, NR6 μl, PGR, RARB, FGF1, FGF2, FGF6, KLK3, KRT1, APOC1, BRCA1, CHGA, CHGB, CLU, COL1A1, COL6A1, EGF, ERBB2, ERK8, FGF1, FGF10, FGF11, FGF13, FGF14, FGF16, FGF17, FGF18, FGF2, FGF20, FGF21, FGF22, FGF23, FGF3, FGF4, FGF5, FGF6, FGF7, FGF8, FGF9, GNRH1, IGF1, IGF2, IGFBP3, IGFBP6, IL12A, IL1A, IL1B, IL2, IL24, INHA, INSL3, INSL4, KLK10, KLK12, KLK13, KLK14, KLK15, KLK3, KLK4, KLK5, KLK6, KLK9, MMP2, MMP9, MSMB, NTN4, ODZ1, PAP, PLAU, PRL, PSAP, SERPINA3, SHBG, TGFA, TIMP3, CD44, CDH1, CDH10, CDH19, CDH20, CDH7, CDH9, CDH1, CDH10, CDH13, CDH18, CDH19, CDH20, CDH7, CDH8, CDH9, ROBO2, CD44, ILK, ITGA1, APC, CD164, COL6A1, MTSS1, PAP, TGFB1I1, AGR2, AIG1, AKAP1, AKAP2, CANT1, CAV1, CDH12, CLDN3, CLN3, CYB5, CYC1, DAB21P, DES, DNCL1, ELAC2, ENO2, ENO3, FASN, FLJ12584, FLJ25530, GAGEB1, GAGEC1, GGT1, GSTP1, HIP1, HUMCYT2A, IL29, K6HF, KAI1, KRT2A, MIB1, PART1, PATE, PCA3, PIAS2, PIK3CG, PPID, PR1, PSCA, SLC2A2, SLC33 μl, SLC43 μl, STEAP, STEAP2, TPM1, TPM2, TRPC6, ANGPT1, ANGPT2, ANPEP, ECGF1, EREG, FGF1, FGF2, FIGF, FLT1, JAG1, KDR, LAMA5, NRP1, NRP2, PGF, PLXDC1, STAB 1, VEGF, VEGFC, ANGPTL3, BAI1, COL4A3, IL8, LAMA5, NRP1, NRP2, STAB 1, ANGPTL4, PECAM1, PF4, PROK2, SERPINF1, TNFAIP2, CCL11, CCL2, CXCL1, CXCL10, CXCL3, CXCL5, CXCL6, CXCL9, IFNA1, IFNB1, IFNG, IL1B, IL6, MDK, EDG1, EFNA1, EFNA3, EFNB2, EGF, EPHB4, FGFR3, HGF, IGF1, ITGB3, PDGFA, TEK, TGFA, TGFB1, TGFB2, TGFBR1, CCL2, CDH5, COL1A1, EDG1, ENG, ITGAV, ITGB3, THBS1, THBS2, BAD, BAG1, BCL2, CCNA1, CCNA2, CCND1, CCNE1, CCNE2, CDH1 (E-cadherin), CDKN1B (p27Kip1), CDKN2A (p16INK4a), COL6A1, CTNNB1 (b-catenin), CTSB (cathepsin B), ERBB2 (Her-2), ESR1, ESR2, F3 (TF), FOSL1 (FRA-1), GATA3, GSN (Gelsolin), IGFBP2, IL2RA, IL6, IL6R, IL6ST (glycoprotein 130), ITGA6 (a6 integrin), JUN, KLK5, KRT19, MAP2K7 (c-Jun), MKI67 (Ki-67), NGFB (GF), NGFR, NME1 (M23A), PGR, PLAU (uPA), PTEN, SERPINB5 (maspin), SERPINE1 (PAI-1), TGFA, THBS1 (thrombospondin-1), TIE (Tie-1), TNFRSF6 (Fas), TNFSF6 (FasL), TOP2A (topoisomerase IIa), TP53, AZGP1 (zinc-a-glycoprotein), BPAG1 (plectin), CDKN1A (p21Wap1/Cip1), CLDN7 (claudin-7), CLU (clusterin), ERBB2 (Her-2), FGF1, FLRT1 (fibronectin), GABRP (GABAa), GNAS1, ID2, ITGA6 (a6 integrin), ITGB4 (b 4 integrin), KLF5 (GC Box BP), KRT19 (Keratin 19), KRTHB6 (hair-specific type II keratin), MACMARCKS, MT3 (metallothionectin-III), MUC1 (mucin), PTGS2 (COX-2), RAC2 (p21Rac2), S100A2, SCGB1D2 (lipophilin B), SCGB2A1 (mammaglobin 2), SCGB2A2 (mammaglobin 1), SPRR1B (Spr1), THBS1, THBS2, THBS4, and TNFAIP2 (B94), RON, c-Met, CD64, DLL4, PLGF, CTLA4, phophatidylserine, ROBO4, CD80, CD22, CD40, CD23, CD28, CD80, CD55, CD38, CD70, CD74, CD30, CD138, CD56, CD33, CD2, CD137, DR4, DR5, RANKL, VEGFR2, PDGFR, VEGFR1, MTSP1, MSP, EPHB2, EPHA1, EPHA2, EpCAM, PGE2, NKG2D, LPA, SIP, APRIL, BCMA, MAPG, FLT3, PDGFR alpha, PDGFR beta, ROR1, PSMA, PSCA, SCD1, and CD59. To form the bispecific or trispecific antibodies of the invention, antibodies to any combination of these antigens can be made; that is, each of these antigens can be optionally and independently included or excluded from a multispecific antibody according to the present invention.

Monoclonal antibody therapy has become an important therapeutic modality for treating autoimmune and inflammatory disorders (Chan & Carter, 2010, Nature Reviews Immunology 10:301-316; Reichert et al., 2005, Nature Biotechnology 23[9]:1073-1078; herein expressly incorporated by reference). Many proteins have been implicated in general autoimmune and inflammatory responses, and thus may be targeted by the immunoglobulins of the invention. Autoimmune and inflammatory targets include but are not limited to C5, CCL1 (1-309), CCL11 (eotaxin), CCL13 (mcp-4), CCL15 (MIP-1d), CCL16 (HCC-4), CCL17 (TARC), CCL18 (PARC), CCL19, CCL2 (mcp-1), CCL20 (MIP-3a), CCL21 (MIP-2), CCL23 (MPIF-1), CCL24 (MPIF-2/eotaxin-2), CCL25 (TECK), CCL26, CCL3 (MIP-1a), CCL4 (MIP-1b), CCL5 (RANTES), CCL7 (mcp-3), CCL8 (mcp-2), CXCL1, CXCL10 (IP-10), CXCL11 (1-TAC/IP-9), CXCL12 (SDF1), CXCL13, CXCL14, CXCL2, CXCL3, CXCL5 (ENA-78/LIX), CXCL6 (GCP-2), CXCL9,1L13, IL8, CCL13 (mcp-4), CCR1, CCR2, CCR3, CCR4, CCR5, CCR6, CCR7, CCR8, CCR9, CX3CR1, IL8RA, XCR1 (CCXCR1), IFNA2, IL10, IL13, IL17C, IL1A, IL1B, IL1F10, IL1F5, IL1F6, IL1F7, IL1F8, IL1F9, IL22, IL5, IL8, IL9, LTA, LTB, MIF, SCYE1 (endothelial Monocyte-activating cytokine), SPP1, TNF, TNFSF5, IFNA2, IL10RA, IL10RB, IL13, IL13RA1, IL5RA, IL9, IL9R, ABCF1, BCL6, C3, C4A, CEBPB, CRP, ICEBERG, IL1R1, IL1RN, IL8RB, LTB4R, TOLLIP, FADD, IRAK1, IRAK2, MYD88, NCK2, TNFAIP3, TRADD, TRAF1, TRAF2, TRAF3, TRAF4, TRAF5, TRAF6, ACVR1, ACVR1B, ACVR2, ACVR2B, ACVRL1, CD28, CD3E, CD3G, CD3Z, CD69, CD80, CD86, CNR1, CTLA4, CYSLTR1, FCER1A, FCER2, FCGR3A, GPR44, HAVCR2, OPRD1, P2RX7, TLR2, TLR3, TLR4, TLR5, TLR6, TLR7, TLR8, TLR9, TLR10, BLR1, CCL1, CCL2, CCL3, CCL4, CCL5, CCL7, CCL8, CCL11, CCL13, CCL15, CCL16, CCL17, CCL18, CCL19, CCL20, CCL21, CCL22, CCL23, CCL24, CCL25, CCR1, CCR2, CCR3, CCR4, CCR5, CCR6, CCR7, CCR8, CCR9, CX3CL1, CX3CR1, CXCL1, CXCL2, CXCL3, CXCL5, CXCL6, CXCL10, CXCL11, CXCL12, CXCL13, CXCR4, GPR2, SCYE1, SDF2, XCL1, XCL2, XCR1, AMH, AMHR2, BMPR1A, BMPR1B, BMPR2, C19orf10 (IL27w), CER1, CSF1, CSF2, CSF3, DKFZp451J0118, FGF2, GFI1, IFNA1, IFNB1, IFNG, IGF1, IL1A, IL1B, IL1R1, IL1R2, IL2, IL2RA, IL2RB, IL2RG, IL3, IL4, IL4R, IL5, IL5RA, IL6, IL6R, IL65T, IL7, IL8, IL8RA, IL8RB, IL9, IL9R, IL10, IL10RA, IL10RB, IL11, IL12RA, IL12A, IL12B, IL12RB1, IL12RB2,1L13, IL13RA1, IL13RA2, IL15, IL15RA, IL16, IL17, IL17R, IL18, IL18R1,1L19, IL20, KITLG, LEP, LTA, LTB, LTB4R, LTB4R2, LTBR, MIF, NPPB, PDGFB, TBX21, TDGF1, TGFA, TGFB1, TGFB1I1, TGFB2, TGFB3, TGFB1, TGFBR1, TGFBR2, TGFBR3, TH1L, TNF, TNFRSF1A, TNFRSF1B, TNFRSF7, TNFRSF8, TNFRSF9, TNFRSF11A, TNFRSF21, TNFSF4, TNFSF5, TNFSF6, TNFSF11, VEGF, ZFPM2, and RNF110 (ZNF144). To form the bispecific or trispecific antibodies of the invention, antibodies to any combination of these antigens can be made; that is, each of these antigens can be optionally and independently included or excluded from a multispecific antibody according to the present invention.

Exemplary co-targets for autoimmune and inflammatory disorders include but are not limited to IL-1 and TNFalpha, IL-6 and TNFalpha, IL-6 and IL-1, IgE and IL-13, IL-1 and IL-13, IL-4 and IL-13, IL-5 and IL-13, IL-9 and IL-13, CD19 and FcγRIIb, and CD79 and FcγRIIb.

Immunoglobulins of the invention with specificity for the following pairs of targets to treat inflammatory disease are contemplated: TNF and IL-17A; TNF and RANKL; TNF and VEGF; TNF and SOST; TNF and DKK; TNF and alphaVbeta3; TNF and NGF; TNF and IL-23p19; TNF and IL-6; TNF and SOST; TNF and IL-6R; TNF and CD-20; IgE and IL-13; IL-13 and IL23p19; IgE and IL-4; IgE and IL-9; IgE and IL-9; IgE and IL-13; IL-13 and IL-9; IL-13 and IL-4; IL-13 and IL-9; IL-13 and IL-9; IL-13 and IL-4; IL-13 and IL-23p19; IL-13 and IL-9; IL-6R and VEGF; IL-6R and IL-17A; IL-6R and RANKL; IL-17A and IL-1 beta; IL-1 beta and RANKL; IL-1beta and VEGF; RANKL and CD-20; IL-1alpha and IL-1beta; IL-1alpha and IL-1beta.

Pairs of targets that the immunoglobulins described herein can bind and be useful to treat asthma may be determined. In an embodiment, such targets include, but are not limited to, IL-13 and IL-1beta, since IL-1beta is also implicated in inflammatory response in asthma; IL-13 and cytokines and chemokines that are involved in inflammation, such as IL-13 and IL-9; IL-13 and IL-4; IL-13 and IL-5; IL-13 and IL-25; IL-13 and TARC; IL-13 and MDC; IL-13 and MIF; IL-13 and TGF-β; IL-13 and LHR agonist; IL-13 and CL25; IL-13 and SPRR2a; IL-13 and SPRR2b; and IL-13 and ADAM8. The immunoglobulins herein may have specificity for one or more targets involved in asthma selected from the group consisting of CSF1 (MCSF), CSF2 (GM-CSF), CSF3 (GCSF), FGF2, IFNA1, IFNB1, IFNG, histamine and histamine receptors, IL1A, IL1B, IL2, IL3, IL4, IL5, IL6, IL7, IL8, IL9, IL10, IL11, IL12A, IL12B, IL13, IL14, IL15, IL16, IL17, IL18, IL19, KITLG, PDGFB, IL2RA, IL4R, IL5RA, IL8RA, IL8RB, IL12RB1, IL12RB2, IL13RA1, IL13RA2, IL18R1, TSLP, CCLi, CCL2, CCL3, CCL4, CCL5, CCL7, CCL8, CCL13, CCL17, CCL18, CCL19, CCL20, CCL22, CCL24, CX3CL1, CXCL1, CXCL2, CXCL3, XCLi, CCR2, CCR3, CCR4, CCR5, CCR6, CCR7, CCR8, CX3CR1, GPR2, XCR1, FOS, GATA3, JAK1, JAK3, STAT6, TBX21, TGFB1, TNF, TNFSF6, YY1, CYSLTR1, FCER1A, FCER2, LTB4R, TB4R2, LTBR, and Chitinase. To form the bispecific or trispecific antibodies of the invention, antibodies to any combination of these antigens can be made; that is, each of these antigens can be optionally and independently included or excluded from a multispecific antibody according to the present invention.

Pairs of targets involved in rheumatoid arthritis (RA) may be co-targeted by the invention, including but not limited to TNF and IL-18; TNF and IL-12; TNF and IL-23; TNF and IL-1beta; TNF and MIF; TNF and IL-17; and TNF and IL-15.

Antigens that may be targeted in order to treat systemic lupus erythematosus (SLE) by the immunoglobulins herein include but are not limited to CD-20, CD-22, CD-19, CD28, CD4, CD80, HLA-DRA, IL10, IL2, IL4, TNFRSF5, TNFRSF6, TNFSF5, TNFSF6, BLR1, HDAC4, HDAC5, HDAC7A, HDAC9, ICOSL, IGBP1, MS4A1, RGSI, SLA2, CD81, IFNB1, IL10, TNFRSF5, TNFRSF7, TNFSF5, AICDA, BLNK, GALNAC4S-6ST, HDAC4, HDAC5, HDAC7A, HDAC9, IL10, IL11, IL4, INHA, INHBA, KLF6, TNFRSF7, CD28, CD38, CD69, CD80, CD83, CD86, DPP4, FCER2, IL2RA, TNFRSF8, TNFSF7, CD24, CD37, CD40, CD72, CD74, CD79A, CD79B, CR2, ILIR2, ITGA2, ITGA3, MS4A1, ST6GALI, CDIC, CHSTIO, HLA-A, HLA-DRA, and NT5E.; CTLA4, B7.1, B7.2, BlyS, BAFF, C5, IL-4, IL-6, IL-10, IFN-α, and TNF-α. To form the bispecific or trispecific antibodies of the invention, antibodies to any combination of these antigens can be made; that is, each of these antigens can be optionally and independently included or excluded from a multispecific antibody according to the present invention.

The immunoglobulins herein may target antigens for the treatment of multiple sclerosis (MS), including but not limited to IL-12, TWEAK, IL-23, CXCL13, CD40, CD40L, IL-18, VEGF, VLA-4, TNF, CD45RB, CD200, IFNgamma, GM-CSF, FGF, C5, CD52, and CCR2. An embodiment includes co-engagement of anti-IL-12 and TWEAK for the treatment of MS.

One aspect of the invention pertains to immunoglobulins capable of binding one or more targets involved in sepsis, in an embodiment two targets, selected from the group consisting TNF, IL-1, MIF, IL-6, IL-8, IL-18, IL-12, IL-23, FasL, LPS, Toll-like receptors, TLR-4, tissue factor, MIP-2, ADORA2A, CASP1, CASP4, IL-10, IL-1B, NFκB1, PROC, TNFRSFIA, CSF3, CCR3, ILIRN, MIF, NFκB1, PTAFR, TLR2, TLR4, GPR44, HMOX1, midkine, IRAK1, NFκB2, SERPINA1, SERPINE1, and TREM1. To form the bispecific or trispecific antibodies of the invention, antibodies to any combination of these antigens can be made; that is, each of these antigens can be optionally and independently included or excluded from a multispecific antibody according to the present invention.

In some cases, immunoglobulins herein may be directed against antigens for the treatment of infectious diseases.

Antigen Binding Domains

As will be appreciated by those in the art, there are two basic types of antigen binding domains, those that resemble antibody antigen binding domains (e.g. comprising a set of 6 CDRs) and those that can be ligands or receptors, for example, that bind to targets without the use of CDRs.

Modified Antibodies

In addition to the modifications outlined above, other modifications can be made. For example, the molecules may be stabilized by the incorporation of disulphide bridges linking the VH and VL domains (Reiter et al., 1996, Nature Biotech. 14:1239-1245, entirely incorporated by reference). In addition, there are a variety of covalent modifications of antibodies that can be made as outlined below.

Covalent modifications of antibodies are included within the scope of this invention, and are generally, but not always, done post-translationally. For example, several types of covalent modifications of the antibody are introduced into the molecule by reacting specific amino acid residues of the antibody with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues may also be derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole and the like.

In addition, modifications at cysteines are particularly useful in antibody-drug conjugate (ADC) applications, further described below. In some embodiments, the constant region of the antibodies can be engineered to contain one or more cysteines that are particularly "thiol reactive", so as to allow more specific and controlled placement of the drug moiety. See for example U.S. Pat. No. 7,521,541, incorporated by reference in its entirety herein.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1M sodium cacodylate at pH 6.0.

Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using 125I or 131I to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking antibodies to a water-insoluble support matrix or surface for use in a variety of methods, in addition to methods described below. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis (succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cynomolgusogen bromide-activated carbohydrates and the reactive substrates described in U.S. Pat. Nos. 3,969,287; 3,691,016; 4,195,128; 4,247,642; 4,229,537; and 4,330,440, all entirely incorporated by reference, are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, pp. 79-86 [1983], entirely incorporated by reference), acetylation of the N-terminal amine, and amidation of any C-terminal carboxyl group.

In addition, as will be appreciated by those in the art, labels (including fluorescent, enzymatic, magnetic, radioactive, etc. can all be added to the antibodies (as well as the other compositions of the invention).

Glycosylation

Another type of covalent modification is alterations in glycosylation. In another embodiment, the antibodies disclosed herein can be modified to include one or more engineered glycoforms. By "engineered glycoform" as used herein is meant a carbohydrate composition that is covalently attached to the antibody, wherein said carbohydrate composition differs chemically from that of a parent antibody. Engineered glycoforms may be useful for a variety of purposes, including but not limited to enhancing or reducing effector function. A preferred form of engineered glycoform is afucosylation, which has been shown to be correlated to an increase in ADCC function, presumably through tighter binding to the FcγRIIIa receptor. In this context, "afucosylation" means that the majority of the antibody produced in the host cells is substantially devoid of fucose, e.g. 90-95-98% of the generated antibodies do not have appreciable fucose as a component of the carbohydrate moiety of the antibody (generally attached at N297 in the Fc region). Defined functionally, afucosylated antibodies generally exhibit at least a 50% or higher affinity to the FcγRIIIa receptor.

Engineered glycoforms may be generated by a variety of methods known in the art (Umalia et al., 1999, Nat Biotechnol 17:176-180; Davies et al., 2001, Biotechnol Bioeng 74:288-294; Shields et al., 2002, J Biol Chem 277:26733-26740; Shinkawa et al., 2003, J Biol Chem 278:3466-3473; U.S. Pat. No. 6,602,684; U.S. Ser. No. 10/277,370; U.S. Ser. No. 10/113,929; PCT WO 00/61739A1; PCT WO 01/29246A1; PCT WO 02/31140A1; PCT WO 02/30954A1, all entirely incorporated by reference; (Potelligent® technology [Biowa, Inc., Princeton, N.J.]; GlycoMAbe® glycosylation engineering technology [Glycart Biotechnology AG, Zurich, Switzerland]). Many of these techniques are based on controlling the level of fucosylated and/or bisecting oligosaccharides that are covalently attached to the Fc region, for example by expressing an IgG in various organisms or cell lines, engineered or otherwise (for example Lec-13 CHO cells or rat hybridoma YB2/0 cells, by regulating enzymes involved in the glycosylation pathway (for example FUT8 [α1,6-fucosyltranserase] and/or β1-4-N-acetylglucosaminyltransferase III [GnTIII]), or by modifying carbohydrate(s) after the IgG has been expressed. For example, the "sugar engineered antibody" or "SEA technology" of Seattle Genetics functions by adding modified saccharides that inhibit fucosylation during production; see for example 20090317869, hereby incorporated by reference in its entirety. Engineered glycoform typically refers to the different carbohydrate or oligosaccharide; thus an antibody can include an engineered glycoform.

Alternatively, engineered glycoform may refer to the IgG variant that comprises the different carbohydrate or oligosaccharide. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antibody amino acid sequence is preferably altered through changes at the DNA level, particularly by mutating the DNA encoding the target polypeptide at preselected bases such that codons are generated that will translate into the desired amino acids.

Another means of increasing the number of carbohydrate moieties on the antibody is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 and in Aplin and Wriston, 1981, CRC Crit. Rev. Biochem., pp. 259-306, both entirely incorporated by reference.

Removal of carbohydrate moieties present on the starting antibody (e.g. post-translationally) may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131, both entirely incorporated by reference. Enzymatic cleavage of carbohydrate moieties on polypeptides can be achieved by the use of a variety of endo- and exo-glycosidases as described by Thotakura et al., 1987, Meth. Enzymol. 138:350, entirely incorporated by reference. Glycosylation at potential glycosylation sites may be prevented by the use of the compound tunicamycin as described by Duskin et al., 1982, J. Biol. Chem. 257:3105, entirely incorporated by reference. Tunicamycin blocks the formation of protein-N-glycoside linkages.

Another type of covalent modification of the antibody comprises linking the antibody to various nonproteinaceous polymers, including, but not limited to, various polyols such as polyethylene glycol, polypropylene glycol or polyoxyalkylenes, in the manner set forth in, for example, 2005-2006 PEG Catalog from Nektar Therapeutics (available at the Nektar website) U.S. Pat. Nos. 4,640,835; 4,496,689; 4,301,144; 4,670,417; 4,791,192 or 4,179,337, all entirely incorporated by reference. In addition, as is known in the art, amino acid substitutions may be made in various positions within the antibody to facilitate the addition of polymers such as PEG. See for example, U.S. Publication No. 2005/0114037A1, entirely incorporated by reference.

Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. No. 11/174,287, Ser. No. 11/396,495, Ser. No. 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E328F, 236A/332E, 239D/332E/330Y, 239D, 332E/330L, 243A, 243L, 264A, 264V and 299T.

In addition, there are additional Fc substitutions that find use in increased binding to the FcRn receptor and increased serum half life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

Linkers

The present invention optionally provides linkers as needed, for example in the addition of additional antigen binding sites, as depicted for example in FIG. 2, where "the other end" of the molecule contains additional antigen binding components. In addition, as outlined below, linkers are optionally also used in antibody drug conjugate (ADC) systems. When used to join the components of the central mAb-Fv constructs, the linker is generally a polypeptide comprising two or more amino acid residues joined by peptide bonds and are used to link one or more of the components of the present invention. Such linker polypeptides are well known in the art (see e.g., Holliger, P., et al. (1993) Proc. Natl. Acad. Sci. USA 90:6444-6448; Poljak, R. J., et al. (1994) Structure 2:1121-1123). A variety of linkers may find use in some embodiments described herein. As will be appreciated by those in the art, there are at least three different linker types used in the present invention.

"Linker" herein is also referred to as "linker sequence", "spacer", "tethering sequence" or grammatical equivalents thereof. Homo- or hetero-bifunctional linkers as are well known (see, 1994 Pierce Chemical Company catalog, technical section on cross-linkers, pages 155-200, incorporated entirely by reference). A number of strategies may be used to covalently link molecules together. These include, but are not limited to polypeptide linkages between N- and C-termini of proteins or protein domains, linkage via disulfide bonds, and linkage via chemical cross-linking reagents. In one aspect of this embodiment, the linker is a peptide bond, generated by recombinant techniques or peptide synthesis. The linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used. Useful linkers include glycine-serine polymers, including for example (GS)n, (GSGGS)n, (GGGGS)n, and (GGGS)n, where n is an integer of at least one, glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cµ. Linker sequences may also be derived from other proteins such as Ig-like proteins (e.g. TCR, FcR, KIR), hinge region-derived sequences, and other natural sequences from other proteins.

Antibody-Drug Conjugates

In some embodiments, the multispecific antibodies of the invention are conjugated with drugs to form antibody-drug conjugates (ADCs). In general, ADCs are used in oncology applications, where the use of antibody-drug conjugates for the local delivery of cytotoxic or cytostatic agents allows for the targeted delivery of the drug moiety to tumors, which can allow higher efficacy, lower toxicity, etc. An overview of this technology is provided in Ducry et al., Bioconjugate Chem., 21:5-13 (2010), Carter et al., Cancer J. 14(3):154 (2008) and Senter, Current Opin. Chem. Biol. 13:235-244 (2009), all of which are hereby incorporated by reference in their entirety.

Thus the invention provides multispecific antibodies conjugated to drugs. Generally, conjugation is done by covalent attachment to the antibody, as further described below, and generally relies on a linker, often a peptide linkage (which, as described below, may be designed to be sensitive to cleavage by proteases at the target site or not). In addition, as described above, linkage of the linker-drug unit (LU-D) can be done by attachment to cysteines within the antibody. As will be appreciated by those in the art, the number of drug moieties per antibody can change, depending on the conditions of the reaction, and can vary from 1:1 to 10:1 drug:antibody. As will be appreciated by those in the art, the actual number is an average.

Thus the invention provides multispecific antibodies conjugated to drugs. As described below, the drug of the ADC can be any number of agents, including but not limited to cytotoxic agents such as chemotherapeutic agents, growth inhibitory agents, toxins (for example, an enzymatically active toxin of bacterial, fungal, plant, or animal origin, or fragments thereof), or a radioactive isotope (that is, a radioconjugate) are provided. In other embodiments, the invention further provides methods of using the ADCs.

Drugs for use in the present invention include cytotoxic drugs, particularly those which are used for cancer therapy. Such drugs include, in general, DNA damaging agents, anti-metabolites, natural products and their analogs. Exemplary classes of cytotoxic agents include the enzyme inhibitors such as dihydrofolate reductase inhibitors, and thymidylate synthase inhibitors, DNA intercalators, DNA cleavers, topoisomerase inhibitors, the anthracycline family of drugs, the vinca drugs, the mitomycins, the bleomycins, the cytotoxic nucleosides, the pteridine family of drugs, diynenes, the podophyllotoxins, dolastatins, maytansinoids, differentiation inducers, and taxols.

Members of these classes include, for example, methotrexate, methopterin, dichloromethotrexate, 5-fluorouracil, 6-mercaptopurine, cytosine arabinoside, melphalan, leurosine, leurosideine, actinomycin, daunorubicin, doxorubicin, mitomycin C, mitomycin A, caminomycin, aminopterin, tallysomycin, podophyllotoxin and podophyllotoxin derivatives such as etoposide or etoposide phosphate, vinblastine, vincristine, vindesine, taxanes including taxol, taxotere retinoic acid, butyric acid, N8-acetyl spermidine, camptothecin, calicheamicin, esperamicin, ene-diynes, duocarmycin A, duocarmycin SA, calicheamicin, camptothecin, maytansinoids (including DM1), monomethylauristatin E (MMAE), monomethylauristatin F (MMAF), and maytansinoids (DM4) and their analogues.

Toxins may be used as antibody-toxin conjugates and include bacterial toxins such as diphtheria toxin, plant toxins such as ricin, small molecule toxins such as geldanamycin (Mendler et al (2000) J. Nat. Cancer Inst. 92(19):1573-1581; Mandler et al (2000) Bioorganic & Med. Chem. Letters 10:1025-1028; Mandler et al (2002) Bioconjugate Chem. 13:786-791), maytansinoids (EP 1391213; Liu et al., (1996) Proc. Natl. Acad. Sci. USA 93:8618-8623), and calicheamicin (Lode et al (1998) Cancer Res. 58:2928; Hinman et al (1993) Cancer Res. 53:3336-3342). Toxins may exert their cytotoxic and cytostatic effects by mechanisms including tubulin binding, DNA binding, or topoisomerase inhibition.

Conjugates of a multispecific antibody and one or more small molecule toxins, such as a maytansinoids, dolastatins, auristatins, a trichothecene, calicheamicin, and CC1065, and the derivatives of these toxins that have toxin activity, are contemplated.

Maytansinoids

Maytansine compounds suitable for use as maytansinoid drug moieties are well known in the art, and can be isolated from natural sources according to known methods, produced using genetic engineering techniques (see Yu et al (2002) PNAS 99:7968-7973), or maytansinol and maytansinol analogues prepared synthetically according to known methods. As described below, drugs may be modified by the incorporation of a functionally active group such as a thiol or amine group for conjugation to the antibody.

Exemplary maytansinoid drug moieties include those having a modified aromatic ring, such as: C-19-dechloro (U.S. Pat. No. 4,256,746) (prepared by lithium aluminum hydride reduction of ansamytocin P2); C-20-hydroxy (or C-20-demethyl) +/−C-19-dechloro (U.S. Pat. Nos. 4,361,650 and 4,307,016) (prepared by demethylation using *Streptomyces* or *Actinomyces* or dechlorination using LAH); and C-20-demethoxy, C-20-acyloxy (—OCOR), +/−dechloro (U.S. Pat. No. 4,294,757) (prepared by acylation using acyl chlorides) and those having modifications at other positions Exemplary maytansinoid drug moieties also include those having modifications such as: C-9-SH (U.S. Pat. No. 4,424,219) (prepared by the reaction of maytansinol with H2S or P2S5); C-14-alkoxymethyl(demethoxy/CH2OR) (U.S. Pat. No. 4,331,598); C-14-hydroxymethyl or acyloxymethyl (CH2OH or CH2OAc) (U.S. Pat. No. 4,450,254) (prepared from Nocardia); C-15-hydroxy/acyloxy (U.S. Pat. No. 4,364,866) (prepared by the conversion of maytansinol by *Streptomyces*); C-15-methoxy (U.S. Pat. Nos. 4,313,946 and 4,315,929) (isolated from Trewia nudlflora); C-18-N-demethyl (U.S. Pat. Nos. 4,362,663 and 4,322,348) (prepared by the demethylation of maytansinol by *Streptomyces*); and 4,5-deoxy (U.S. Pat. No. 4,371,533) (prepared by the titanium trichloride/LAH reduction of maytansinol).

Of particular use are DM1 (disclosed in U.S. Pat. No. 5,208,020, incorporated by reference) and DM4 (disclosed in U.S. Pat. No. 7,276,497, incorporated by reference). See also a number of additional maytansinoid derivatives and methods in U.S. Pat. No. 5,416,064, WO/01/24763, U.S. Pat. No. 7,303,749, U.S. Pat. No. 7,601,354, U.S. Ser. No. 12/631,508, WO02/098883, U.S. Pat. No. 6,441,163, U.S. Pat. No. 7,368,565, WO02/16368 and WO04/1033272, all of which are expressly incorporated by reference in their entirety.

ADCs containing maytansinoids, methods of making same, and their therapeutic use are disclosed, for example, in U.S. Pat. Nos. 5,208,020; 5,416,064; 6,441,163 and European Patent EP 0 425 235 B1, the disclosures of which are hereby expressly incorporated by reference. Liu et al., Proc. Natl. Acad. Sci. USA 93:8618-8623 (1996) described ADCs comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay.

Chari et al., Cancer Research 52:127-131 (1992) describe ADCs in which a maytansinoid was conjugated via a disulfide linker to the murine antibody A7 binding to an antigen on human colon cancer cell lines, or to another murine monoclonal antibody TA.1 that binds the HER-2/neu oncogene. The cytotoxicity of the TA.1-maytansonoid conjugate was tested in vitro on the human breast cancer cell line SK-BR-3, which expresses 3×105 HER-2 surface antigens per cell. The drug conjugate achieved a degree of cytotoxicity similar to the free maytansinoid drug, which could be increased by increasing the number of maytansinoid molecules per antibody molecule. The A7-maytansinoid conjugate showed low systemic cytotoxicity in mice.

Auristatins and Dolastatins

In some embodiments, the ADC comprises a multispecific antibody conjugated to dolastatins or dolostatin peptidic analogs and derivatives, the auristatins (U.S. Pat. Nos. 5,635,483; 5,780,588). Dolastatins and auristatins have been shown to interfere with microtubule dynamics, GTP hydrolysis, and nuclear and cellular division (Woyke et al (2001) Antimicrob. Agents and Chemother. 45(12):3580-3584) and have anticancer (U.S. Pat. No. 5,663,149) and antifungal activity (Pettit et al (1998) Antimicrob. Agents Chemother. 42:2961-2965). The dolastatin or auristatin drug moiety may be attached to the antibody through the N (amino) terminus or the C (carboxyl) terminus of the peptidic drug moiety (WO 02/088172).

Exemplary auristatin embodiments include the N-terminus linked monomethylauristatin drug moieties DE and DF, disclosed in "Senter et al, Proceedings of the American Association for Cancer Research, Volume 45, Abstract Number 623, presented Mar. 28, 2004 and described in United States Patent Publication No. 2005/0238648, the disclosure of which is expressly incorporated by reference in its entirety.

An exemplary auristatin embodiment is MMAE (see U.S. Pat. No. 6,884,869 expressly incorporated by reference in its entirety).

Another exemplary auristatin embodiment is MMAF (see US 2005/0238649, U.S. Pat. Nos. 5,767,237 and 6,124,431, expressly incorporated by reference in their entirety).

Additional exemplary embodiments comprising MMAE or MMAF and various linker components (described further herein) have the following structures and abbreviations (wherein Ab means antibody and p is 1 to about 8):

Typically, peptide-based drug moieties can be prepared by forming a peptide bond between two or more amino acids and/or peptide fragments. Such peptide bonds can be prepared, for example, according to the liquid phase synthesis method (see E. Schroder and K. Lubke, "The Peptides", volume 1, pp 76-136, 1965, Academic Press) that is well known in the field of peptide chemistry. The auristatin/dolastatin drug moieties may be prepared according to the methods of: U.S. Pat. No. 5,635,483; U.S. Pat. No. 5,780,588; Pettit et al (1989) J. Am. Chem. Soc. 111:5463-5465; Pettit et al (1998) Anti-Cancer Drug Design 13:243-277; Pettit, G. R., et al. Synthesis, 1996, 719-725; Pettit et al (1996) J. Chem. Soc. Perkin Trans. 1 5:859-863; and Doronina (2003) Nat Biotechnol 21(7):778-784.

Calicheamicin

In other embodiments, the ADC comprises an antibody of the invention conjugated to one or more calicheamicin molecules. For example, Mylotarg is the first commercial ADC drug and utilizes calicheamicin γ1 as the payload (see U.S. Pat. No. 4,970,198, incorporated by reference in its entirety). Additional calicheamicin derivatives are described in U.S. Pat. Nos. 5,264,586, 5,384,412, 5,550,246, 5,739,116, 5,773,001, 5,767,285 and 5,877,296, all expressly incorporated by reference. The calicheamicin family of antibiotics are capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296 (all to American Cyanamid Company). Structural analogues of calicheamicin which may be used include, but are not limited to, γ1I, α2I, α2I, N-acetyl-γ1I, PSAG and θI1 (Hinman et al., Cancer Research 53:3336-3342 (1993), Lode et al., Cancer Research 58:2925-2928 (1998) and the aforementioned U.S. patents to American Cyanamid). Another anti-tumor drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

Duocarmycins

CC-1065 (see U.S. Pat. No. 4,169,888, incorporated by reference) and duocarmycins are members of a family of antitumor antibiotics utilized in ADCs. These antibiotics appear to work through sequence-selectively alkylating DNA at the N3 of adenine in the minor groove, which initiates a cascade of events that result in apoptosis.

Important members of the duocarmycins include duocarmycin A (U.S. Pat. No. 4,923,990, incorporated by reference) and duocarmycin SA (U.S. Pat. No. 5,101,038, incorporated by reference), and a large number of analogues as described in U.S. Pat. Nos. 7,517,903, 7,691,962, 5,101,038; 5,641,780; 5,187,186; 5,070,092; 5,070,092; 5,641,780; 5,101,038; 5,084,468, 5,475,092, 5,585,499, 5,846,545, WO2007/089149, WO2009/017394A1, U.S. Pat. Nos. 5,703,080, 6,989,452, 7,087,600, 7,129,261, 7,498,302, and 7,507,420, all of which are expressly incorporated by reference.

Other Cytotoxic Aments

Other antitumor agents that can be conjugated to the antibodies of the invention include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof which can be used include diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin and the tricothecenes. See, for example, WO 93/21232 published Oct. 28, 1993.

The present invention further contemplates an ADC formed between an antibody and a compound with nucleolytic activity (e.g., a ribonuclease or a DNA endonuclease such as a deoxyribonuclease; DNase).

For selective destruction of the tumor, the antibody may comprise a highly radioactive atom. A variety of radioactive isotopes are available for the production of radioconjugated antibodies. Examples include At211, I131, I125, Y90, Re186, Re188, Sm153, Bi212, P32, Pb212 and radioactive isotopes of Lu.

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as Tc99m or I123, Re186, Re188 and In111 can be attached via a cysteine residue in the peptide. Yttrium-90 can be attached via a lysine residue. The IODOGEN method (Fraker et al (1978) Biochem. Biophys. Res. Commun. 80: 49-57 can be used to incorporate Iodine-123. "Monoclonal Antibodies in Immunoscintigraphy" (Chatal, CRC Press 1989) describes other methods in detail.

For compositions comprising a plurality of antibodies, the drug loading is represented by p, the average number of drug molecules per Antibody. Drug loading may range from 1 to 20 drugs (D) per Antibody. The average number of drugs per antibody in preparation of conjugation reactions may be characterized by conventional means such as mass spectroscopy, ELISA assay, and HPLC. The quantitative distribution of Antibody-Drug-Conjugates in terms of p may also be determined.

In some instances, separation, purification, and characterization of homogeneous Antibody-Drug-conjugates where p is a certain value from Antibody-Drug-Conjugates with other drug loadings may be achieved by means such as reverse phase HPLC or electrophoresis. In exemplary embodiments, p is 2, 3, 4, 5, 6, 7, or 8 or a fraction thereof.

The generation of Antibody-drug conjugate compounds can be accomplished by any technique known to the skilled artisan. Briefly, the Antibody-drug conjugate compounds can include a multispecific antibody as the Antibody unit, a drug, and optionally a linker that joins the drug and the binding agent.

A number of different reactions are available for covalent attachment of drugs and/or linkers to binding agents. This is can be accomplished by reaction of the amino acid residues of the binding agent, for example, antibody molecule, including the amine groups of lysine, the free carboxylic acid groups of glutamic and aspartic acid, the sulfhydryl groups of cysteine and the various moieties of the aromatic amino acids. A commonly used non-specific methods of covalent attachment is the carbodiimide reaction to link a carboxy (or amino) group of a compound to amino (or carboxy) groups of the antibody. Additionally, bifunctional agents such as dialdehydes or imidoesters have been used to link the amino group of a compound to amino groups of an antibody molecule.

Also available for attachment of drugs to binding agents is the Schiff base reaction. This method involves the periodate oxidation of a drug that contains glycol or hydroxy groups, thus forming an aldehyde which is then reacted with the binding agent. Attachment occurs via formation of a Schiff base with amino groups of the binding agent. Isothiocyanates can also be used as coupling agents for covalently attaching drugs to binding agents. Other techniques are known to the skilled artisan and within the scope of the present invention.

In some embodiments, an intermediate, which is the precursor of the linker, is reacted with the drug under appropriate conditions. In other embodiments, reactive groups are used on the drug and/or the intermediate. The product of the reaction between the drug and the intermediate, or the derivatized drug, is subsequently reacted with an multispecific antibody of the invention under appropriate conditions.

It will be understood that chemical modifications may also be made to the desired compound in order to make reactions of that compound more convenient for purposes of preparing conjugates of the invention. For example a functional group e.g. amine, hydroxyl, or sulfhydryl, may be appended to the drug at a position which has minimal or an acceptable effect on the activity or other properties of the drug ADC Linker Units Typically, the antibody-drug conjugate compounds comprise a Linker unit between the drug unit and the antibody unit. In some embodiments, the linker is cleavable under intracellular or extracellular conditions, such that cleavage of the linker releases the drug unit from the antibody in the appropriate environment. For example, solid tumors that secrete certain proteases may serve as the target of the cleavable linker; in other embodiments, it is the intracellular proteases that are utilized. In yet other embodiments, the linker unit is not cleavable and the drug is released, for example, by antibody degradation in lysosomes.

In some embodiments, the linker is cleavable by a cleaving agent that is present in the intracellular environment (for example, within a lysosome or endosome or caveolea). The linker can be, for example, a peptidyl linker that is cleaved by an intracellular peptidase or protease enzyme, including, but not limited to, a lysosomal or endosomal protease. In some embodiments, the peptidyl linker is at least two amino acids long or at least three amino acids long or more.

Cleaving agents can include, without limitation, cathepsins B and D and plasmin, all of which are known to hydrolyze dipeptide drug derivatives resulting in the release of active drug inside target cells (see, e.g., Dubowchik and Walker, 1999, Pharm. Therapeutics 83:67-123). Peptidyl linkers that are cleavable by enzymes that are present in CD38-expressing cells. For example, a peptidyl linker that is cleavable by the thiol-dependent protease cathepsin-B, which is highly expressed in cancerous tissue, can be used (e.g., a Phe-Leu or a Gly-Phe-Leu-Gly linker (SEQ ID NO: 509)). Other examples of such linkers are described, e.g., in U.S. Pat. No. 6,214,345, incorporated herein by reference in its entirety and for all purposes.

In some embodiments, the peptidyl linker cleavable by an intracellular protease is a Val-Cit linker or a Phe-Lys linker (see, e.g., U.S. Pat. No. 6,214,345, which describes the synthesis of doxorubicin with the val-cit linker).

In other embodiments, the cleavable linker is pH-sensitive, that is, sensitive to hydrolysis at certain pH values. Typically, the pH-sensitive linker hydrolyzable under acidic conditions. For example, an acid-labile linker that is hydrolyzable in the lysosome (for example, a hydrazone, semicarbazone, thiosemicarbazone, cis-aconitic amide, orthoester, acetal, ketal, or the like) may be used. (See, e.g., U.S. Pat. Nos. 5,122,368; 5,824,805; 5,622,929; Dubowchik and Walker, 1999, Pharm. Therapeutics 83:67-123; Neville et al., 1989, Biol. Chem. 264:14653-14661.) Such linkers are relatively stable under neutral pH conditions, such as those in the blood, but are unstable at below pH 5.5 or 5.0, the approximate pH of the lysosome. In certain embodiments, the hydrolyzable linker is a thioether linker (such as, e.g., a thioether attached to the therapeutic agent via an acylhydrazone bond (see, e.g., U.S. Pat. No. 5,622,929).

In yet other embodiments, the linker is cleavable under reducing conditions (for example, a disulfide linker). A variety of disulfide linkers are known in the art, including, for example, those that can be formed using SATA (N-succinimidyl-5-acetylthioacetate), SPDP (N-succinimidyl-3-(2-pyridyldithio)propionate), SPDB (N-succinimidyl-3-(2-pyridyldithio)butyrate) and SMPT (N-succinimidyl-oxycarbonyl-alpha-methyl-alpha-(2-pyridyl-dithio) toluene)-, SPDB and SMPT. (See, e.g., Thorpe et al., 1987, Cancer Res. 47:5924-5931; Wawrzynczak et al., In Immunoconjugates: Antibody Conjugates in Radioimagery and Therapy of Cancer (C. W. Vogel ed., Oxford U. Press, 1987. See also U.S. Pat. No. 4,880,935.)

In other embodiments, the linker is a malonate linker (Johnson et al., 1995, Anticancer Res. 15:1387-93), a maleimidobenzoyl linker (Lau et al., 1995, Bioorg-Med-Chem. 3(10): 1299-1304), or a 3'-N-amide analog (Lau et al., 1995, Bioorg-Med-Chem. 3(10): 1305-12).

In yet other embodiments, the linker unit is not cleavable and the drug is released by antibody degradation. (See U.S. Publication No. 2005/0238649 incorporated by reference herein in its entirety and for all purposes).

In many embodiments, the linker is self-immolative. As used herein, the term "self-immolative Spacer" refers to a bifunctional chemical moiety that is capable of covalently linking together two spaced chemical moieties into a stable tripartite molecule. It will spontaneously separate from the second chemical moiety if its bond to the first moiety is cleaved. See for example, WO 2007059404A2, WO06110476A2, WO05112919A2, WO2010/062171, WO09/017394, WO07/089149, WO 07/018431, WO04/043493 and WO02/083180, which are directed to drug-cleavable substrate conjugates where the drug and cleavable substrate are optionally linked through a self-immolative linker and which are all expressly incorporated by reference.

Often the linker is not substantially sensitive to the extracellular environment. As used herein, "not substantially sensitive to the extracellular environment," in the context of a linker, means that no more than about 20%, 15%, 10%, 5%, 3%, or no more than about 1% of the linkers, in a sample of antibody-drug conjugate compound, are cleaved when the antibody-drug conjugate compound presents in an extracellular environment (for example, in plasma).

Whether a linker is not substantially sensitive to the extracellular environment can be determined, for example, by incubating with plasma the antibody-drug conjugate compound for a predetermined time period (for example, 2, 4, 8, 16, or 24 hours) and then quantitating the amount of free drug present in the plasma.

In other, non-mutually exclusive embodiments, the linker promotes cellular internalization. In certain embodiments, the linker promotes cellular internalization when conjugated to the therapeutic agent (that is, in the milieu of the linker-therapeutic agent moiety of the antibody-drug conjugate compound as described herein). In yet other embodiments, the linker promotes cellular internalization when conjugated to both the auristatin compound and the multispecific antibodies of the invention.

A variety of exemplary linkers that can be used with the present compositions and methods are described in WO 2004-010957, U.S. Publication No. 2006/0074008, U.S. Publication No. 20050238649, and U.S. Publication No. 2006/0024317 (each of which is incorporated by reference herein in its entirety and for all purposes).

Drug Loading

Drug loading is represented by p and is the average number of Drug moieties per antibody in a molecule. Drug loading ("p") may be 1, 2, 3, 4, 5, 6, 7, 8, 9, 10, 11, 12, 13, 14, 15, 16, 17, 18, 19, 20 or more moieties (D) per antibody, although frequently the average number is a fraction or a decimal. Generally, drug loading of from 1 to 4 is frequently useful, and from 1 to 2 is also useful. ADCs of the invention include collections of antibodies conjugated with a range of drug moieties, from 1 to 20. The average number of drug moieties per antibody in preparations of ADC from conjugation reactions may be characterized by conventional means such as mass spectroscopy and, ELISA assay.

The quantitative distribution of ADC in terms of p may also be determined. In some instances, separation, purification, and characterization of homogeneous ADC where p is a certain value from ADC with other drug loadings may be achieved by means such as electrophoresis.

For some antibody-drug conjugates, p may be limited by the number of attachment sites on the antibody. For example, where the attachment is a cysteine thiol, as in the exemplary embodiments above, an antibody may have only one or several cysteine thiol groups, or may have only one or several sufficiently reactive thiol groups through which a linker may be attached. In certain embodiments, higher drug loading, e.g. p>5, may cause aggregation, insolubility, toxicity, or loss of cellular permeability of certain antibody-drug conjugates. In certain embodiments, the drug loading for an ADC of the invention ranges from 1 to about 8; from about 2 to about 6; from about 3 to about 5; from about 3 to about 4; from about 3.1 to about 3.9; from about 3.2 to about 3.8; from about 3.2 to about 3.7; from about 3.2 to about 3.6; from about 3.3 to about 3.8; or from about 3.3 to about 3.7. Indeed, it has been shown that for certain ADCs, the optimal ratio of drug moieties per antibody may be less than 8, and may be about 2 to about 5. See US 2005-0238649 A1 (herein incorporated by reference in its entirety).

In certain embodiments, fewer than the theoretical maximum of drug moieties are conjugated to an antibody during a conjugation reaction. An antibody may contain, for example, lysine residues that do not react with the drug-linker intermediate or linker reagent, as discussed below. Generally, antibodies do not contain many free and reactive cysteine thiol groups which may be linked to a drug moiety; indeed most cysteine thiol residues in antibodies exist as disulfide bridges. In certain embodiments, an antibody may be reduced with a reducing agent such as dithiothreitol (DTT) or tricarbonylethylphosphine (TCEP), under partial or total reducing conditions, to generate reactive cysteine thiol groups. In certain embodiments, an antibody is subjected to denaturing conditions to reveal reactive nucleophilic groups such as lysine or cysteine.

The loading (drug/antibody ratio) of an ADC may be controlled in different ways, e.g., by: (i) limiting the molar excess of drug-linker intermediate or linker reagent relative to antibody, (ii) limiting the conjugation reaction time or temperature, (iii) partial or limiting reductive conditions for cysteine thiol modification, (iv) engineering by recombinant techniques the amino acid sequence of the antibody such that the number and position of cysteine residues is modified for control of the number and/or position of linker-drug attachments (such as thioMab or thioFab prepared as disclosed herein and in WO2006/034488 (herein incorporated by reference in its entirety)).

It is to be understood that where more than one nucleophilic group reacts with a drug-linker intermediate or linker reagent followed by drug moiety reagent, then the resulting product is a mixture of ADC compounds with a distribution of one or more drug moieties attached to an antibody. The average number of drugs per antibody may be calculated from the mixture by a dual ELISA antibody assay, which is specific for antibody and specific for the drug. Individual ADC molecules may be identified in the mixture by mass spectroscopy and separated by HPLC, e.g. hydrophobic interaction chromatography.

In some embodiments, a homogeneous ADC with a single loading value may be isolated from the conjugation mixture by electrophoresis or chromatography.

Methods of Determining Cytotoxic Effect of ADCs

Methods of determining whether a Drug or Antibody-Drug conjugate exerts a cytostatic and/or cytotoxic effect on a cell are known. Generally, the cytotoxic or cytostatic activity of an Antibody Drug conjugate can be measured by: exposing mammalian cells expressing a target protein of the Antibody Drug conjugate in a cell culture medium; culturing the cells for a period from about 6 hours to about 5 days; and measuring cell viability. Cell-based in vitro assays can be used to measure viability (proliferation), cytotoxicity, and induction of apoptosis (caspase activation) of the Antibody Drug conjugate.

For determining whether an Antibody Drug conjugate exerts a cytostatic effect, a thymidine incorporation assay may be used. For example, cancer cells expressing a target antigen at a density of 5,000 cells/well of a 96-well plated can be cultured for a 72-hour period and exposed to 0.5 µCi of 3H-thymidine during the final 8 hours of the 72-hour period. The incorporation of 3H-thymidine into cells of the culture is measured in the presence and absence of the Antibody Drug conjugate.

For determining cytotoxicity, necrosis or apoptosis (programmed cell death) can be measured. Necrosis is typically accompanied by increased permeability of the plasma membrane; swelling of the cell, and rupture of the plasma membrane. Apoptosis is typically characterized by membrane blebbing, condensation of cytoplasm, and the activation of endogenous endonucleases. Determination of any of these effects on cancer cells indicates that an Antibody Drug conjugate is useful in the treatment of cancers.

Cell viability can be measured by determining in a cell the uptake of a dye such as neutral red, trypan blue, or ALAMAR™ blue (see, e.g., Page et al., 1993, Intl. J. Oncology 3:473-476). In such an assay, the cells are incubated in media containing the dye, the cells are washed, and the remaining dye, reflecting cellular uptake of the dye, is measured spectrophotometrically. The protein-binding dye sulforhodamine B (SRB) can also be used to measure cytotoxicity (Skehan et al., 1990, J. Natl. Cancer Inst. 82:1107-12).

Alternatively, a tetrazolium salt, such as MTT, is used in a quantitative colorimetric assay for mammalian cell survival and proliferation by detecting living, but not dead, cells (see, e.g., Mosmann, 1983, J. Immunol. Methods 65:55-63).

Apoptosis can be quantitated by measuring, for example, DNA fragmentation. Commercial photometric methods for the quantitative in vitro determination of DNA fragmentation are available. Examples of such assays, including TUNEL (which detects incorporation of labeled nucleotides in fragmented DNA) and ELISA-based assays, are described in Biochemica, 1999, no. 2, pp. 34-37 (Roche Molecular Biochemicals).

Apoptosis can also be determined by measuring morphological changes in a cell. For example, as with necrosis, loss of plasma membrane integrity can be determined by measuring uptake of certain dyes (e.g., a fluorescent dye such as, for example, acridine orange or ethidium bromide). A method for measuring apoptotic cell number has been described by Duke and Cohen, Current Protocols in Immunology (Coligan et al. eds., 1992, pp. 3.17.1-3.17.16). Cells also can be labeled with a DNA dye (e.g., acridine orange, ethidium bromide, or propidium iodide) and the cells observed for chromatin condensation and margination along the inner nuclear membrane. Other morphological changes that can be measured to determine apoptosis include, e.g., cytoplasmic condensation, increased membrane blebbing, and cellular shrinkage.

The presence of apoptotic cells can be measured in both the attached and "floating" compartments of the cultures. For example, both compartments can be collected by removing the supernatant, trypsinizing the attached cells, combining the preparations following a centrifugation wash step (e.g., 10 minutes at 2000 rpm), and detecting apoptosis (e.g., by measuring DNA fragmentation). (See, e.g., Piazza et al., 1995, Cancer Research 55:3110-16).

In vivo, the effect of a therapeutic composition of the multispecific antibody of the invention can be evaluated in a suitable animal model. For example, xenogenic cancer models can be used, wherein cancer explants or passaged xenograft tissues are introduced into immune compromised animals, such as nude or SCID mice (Klein et al., 1997, Nature Medicine 3: 402-408). Efficacy can be measured using assays that measure inhibition of tumor formation, tumor regression or metastasis, and the like.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16th Edition, A. Osal., Ed., 1980).

Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

The formulation herein may also contain more than one active compound as necessary for the particular indication being treated, preferably those with complementary activities that do not adversely affect each other. For example, it may be desirable to provide antibodies with other specificities. Alternatively, or in addition, the composition may comprise a cytotoxic agent, cytokine, growth inhibitory agent and/or small molecule antagonist. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

The formulations to be used for in vivo administration should be sterile, or nearly so. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and .gamma. ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

When encapsulated antibodies remain in the body for a long time, they may denature or aggregate as a result of exposure to moisture at 37° C., resulting in a loss of biological activity and possible changes in immunogenicity.

Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

Administrative Modalities

The antibodies and chemotherapeutic agents of the invention are administered to a subject, in accord with known methods, such as intravenous administration as a bolus or by continuous infusion over a period of time, by intramuscular, intraperitoneal, intracerobrospinal, subcutaneous, intra-articular, intrasynovial, intrathecal, oral, topical, or inhalation routes. Intravenous or subcutaneous administration of the antibody is preferred.

Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Thus for B cell tumors, the subject may experience a decrease in the so-called B symptoms, i.e., night sweats, fever, weight loss, and/or urticaria. For pre-malignant conditions, therapy with an multispecific therapeutic agent may block and/or prolong the time before development of a related malignant condition, for example, development of multiple myeloma in subjects suffering from monoclonal gammopathy of undetermined significance (MGUS).

An improvement in the disease may be characterized as a complete response. By "complete response" is intended an absence of clinically detectable disease with normalization of any previously abnormal radiographic studies, bone marrow, and cerebrospinal fluid (CSF) or abnormal monoclonal protein in the case of myeloma.

Such a response may persist for at least 4 to 8 weeks, or sometimes 6 to 8 weeks, following treatment according to the methods of the invention. Alternatively, an improvement in the disease may be categorized as being a partial response. By "partial response" is intended at least about a 50% decrease in all measurable tumor burden (i.e., the number of malignant cells present in the subject, or the measured bulk of tumor masses or the quantity of abnormal monoclonal protein) in the absence of new lesions, which may persist for 4 to 8 weeks, or 6 to 8 weeks.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the multispecific antibodies used in the present invention depend on the disease or condition to be treated and may be determined by the persons skilled in the art.

An exemplary, non-limiting range for a therapeutically effective amount of an multispecific antibody used in the present invention is about 0.1-100 mg/kg, such as about 0.1-50 mg/kg, for example about 0.1-20 mg/kg, such as about 0.1-10 mg/kg, for instance about 0.5, about such as 0.3, about 1, or about 3 mg/kg. In another embodiment, the antibody is administered in a dose of 1 mg/kg or more, such as a dose of from 1 to 20 mg/kg, e.g. a dose of from 5 to 20 mg/kg, e.g. a dose of 8 mg/kg.

A medical professional having ordinary skill in the art may readily determine and prescribe the effective amount of the pharmaceutical composition required. For example, a physician or a veterinarian could start doses of the medicament employed in the pharmaceutical composition at levels lower than that required in order to achieve the desired therapeutic effect and gradually increase the dosage until the desired effect is achieved.

In one embodiment, the multispecific antibody is administered by infusion in a weekly dosage of from 10 to 500 mg/kg such as of from 200 to 400 mg/kg Such administration may be repeated, e.g., 1 to 8 times, such as 3 to 5 times. The administration may be performed by continuous infusion over a period of from 2 to 24 hours, such as of from 2 to 12 hours.

In one embodiment, the multispecific antibody is administered by slow continuous infusion over a long period, such as more than 24 hours, if required to reduce side effects including toxicity.

In one embodiment the multispecific antibody is administered in a weekly dosage of from 250 mg to 2000 mg, such as for example 300 mg, 500 mg, 700 mg, 1000 mg, 1500 mg or 2000 mg, for up to 8 times, such as from 4 to 6 times. The administration may be performed by continuous infusion over a period of from 2 to 24 hours, such as of from 2 to 12 hours. Such regimen may be repeated one or more times as necessary, for example, after 6 months or 12 months. The dosage may be determined or adjusted by measuring the amount of compound of the present invention in the blood upon administration by for instance taking out a biological sample and using anti-idiotypic antibodies which target the antigen binding region of the multispecific antibody.

In a further embodiment, the multispecific antibody is administered once weekly for 2 to 12 weeks, such as for 3 to 10 weeks, such as for 4 to 8 weeks.

In one embodiment, the multispecific antibody is administered by maintenance therapy, such as, e.g., once a week for a period of 6 months or more.

In one embodiment, the multispecific antibody is administered by a regimen including one infusion of an multispecific antibody followed by an infusion of an multispecific antibody conjugated to a radioisotope. The regimen may be repeated, e.g., 7 to 9 days later.

As non-limiting examples, treatment according to the present invention may be provided as a daily dosage of an antibody in an amount of about 0.1-100 mg/kg, such as 0.5, 0.9, 1.0, 1.1, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 45, 50, 60, 70, 80, 90 or 100 mg/kg, per day, on at least one of day 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40, or alternatively, at least one of week 1, 2, 3, 4, 5, 6, 7, 8, 9, 10, 11, 12, 13, 14, 15, 16, 17, 18, 19 or 20 after initiation of treatment, or any combination thereof, using single or divided doses of every 24, 12, 8, 6, 4, or 2 hours, or any combination thereof.

In some embodiments the multispecific antibody molecule thereof is used in combination with one or more additional therapeutic agents, e.g. a chemotherapeutic agent. Non-limiting examples of DNA damaging chemotherapeutic agents include topoisomerase I inhibitors (e.g., irinotecan, topotecan, camptothecin and analogs or metabolites thereof, and doxorubicin); topoisomerase II inhibitors (e.g., etoposide, teniposide, and daunorubicin); alkylating agents (e.g., melphalan, chlorambucil, busulfan, thiotepa, ifosfamide, carmustine, lomustine, semustine, streptozocin, decarbazine, methotrexate, mitomycin C, and cyclophosphamide); DNA intercalators (e.g., cisplatin, oxaliplatin, and carboplatin); DNA intercalators and free radical generators such as bleomycin; and nucleoside mimetics (e.g., 5-fluorouracil, capecitibine, gemcitabine, fludarabine, cytarabine, mercaptopurine, thioguanine, pentostatin, and hydroxyurea).

Chemotherapeutic agents that disrupt cell replication include: paclitaxel, docetaxel, and related analogs; vincristine, vinblastin, and related analogs; thalidomide, lenalidomide, and related analogs (e.g., CC-5013 and CC-4047); protein tyrosine kinase inhibitors (e.g., imatinib mesylate and gefitinib); proteasome inhibitors (e.g., bortezomib); NF-κB inhibitors, including inhibitors of IκB kinase; antibodies which bind to proteins overexpressed in cancers and thereby downregulate cell replication (e.g., trastuzumab, rituximab, cetuximab, and bevacizumab); and other inhibitors of proteins or enzymes known to be upregulated, over-expressed or activated in cancers, the inhibition of which downregulates cell replication.

In some embodiments, the antibodies of the invention can be used prior to, concurrent with, or after treatment with Velcade® (bortezomib).

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below are for illustrative purposes only. These examples are not meant to constrain any embodiment disclosed herein to any particular application or theory of operation.

Example 1. Constructing Anti-CD4× Anti-CD25 Bispecific Antibodies

A concept for suppressing Treg cells with anti-CD4× anti-CD25 bispecifics while not affecting other T cell types is shown schematically in FIG. 1.

The ability of various anti-CD25 heavy chains to pair with anti-CD4 light chains and anti-CD4 heavy chains to pair with anti-CD25 light chains in order to create a "common light-chain" anti-CD4×CD25 bispecific antibody was evaluated. Desired gene segments were synthesized by Blue Heron Biotechnologies (Bothell, Wash.) from synthetic oligonucleotides and PCR products by automated gene synthesis. Antibody constructs in the pTT5 vector were expressed in 293E cells and purified by standard Protein A, followed by IEX chromatography in order to isolate the desired heterodimeric bispecific. Biacore was used to examine binding of the various pairs to both CD4 and CD25 and the results tabulated (FIG. 2). 100 nM of each variant was immobilized on a Protein A chip for 1 min, followed by flowing antigen (CD4 or CD25) at 100 nM for 2 min dissociation. As can be seen from the data, the HuMax-TAC anti-CD25 heavy chain has the unique ability to pair with the anti-CD4 lights chains of OKT4A and zanolimumab, with the HuMax-TAC/OKT4A pair showing the strongest binding.

Figure 4:
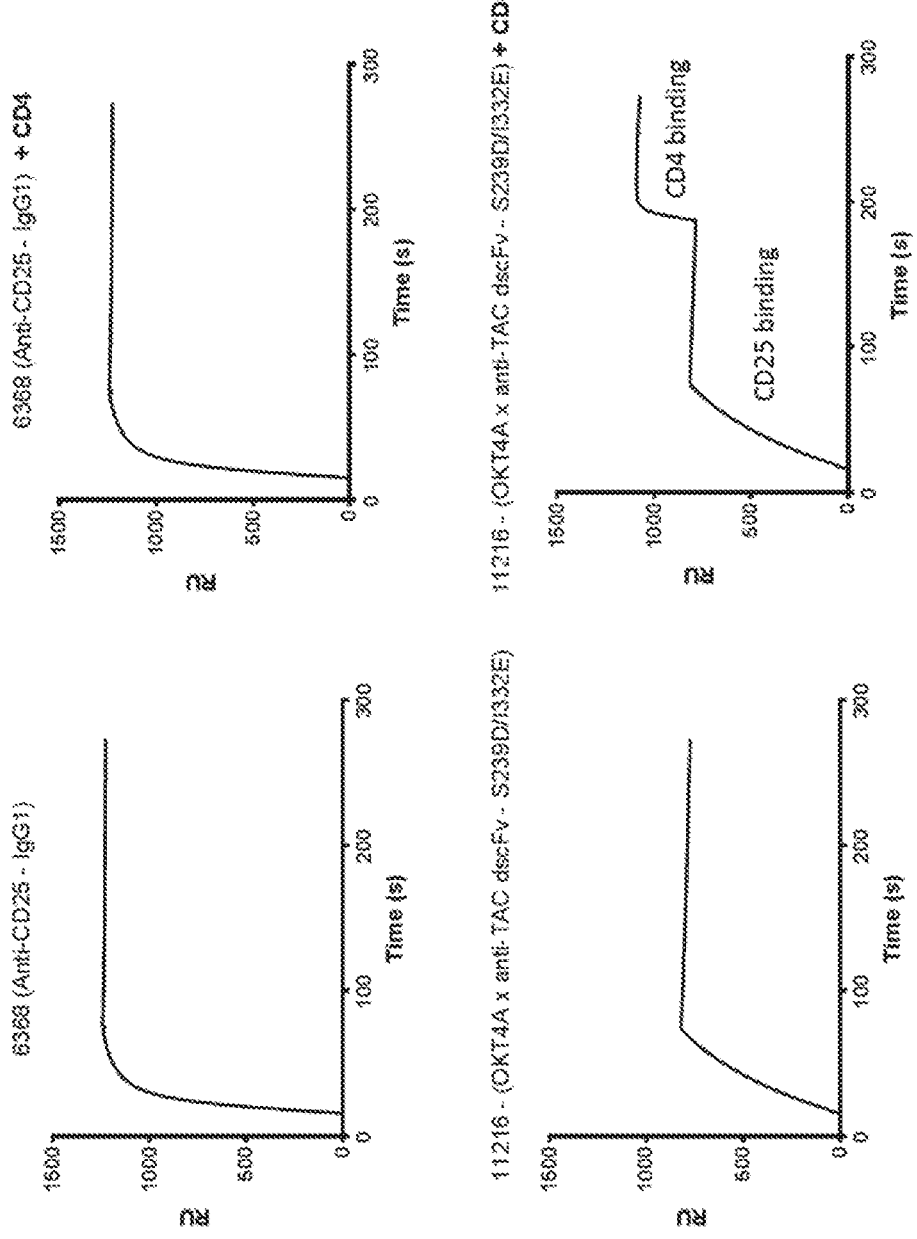
FIG. 4. Dual scFv-Fc bispecific antibody OKT4A_H0L0_scFv_Anti-TAC_H1L1_scFv_GDQ-Fc (216)_IgG1_pI_ISO(−)/pI_ISO(+RR)_IgG1_S239D/I332E can bind to CD25 and CD4 simultaneously. The antibody was bound to a CD25 chip on Biacore followed by binding of CD4. As a control, anti-CD25 antibody Anti-TAC_H1L1_IgG1 does not bind CD4.
Figure 5:
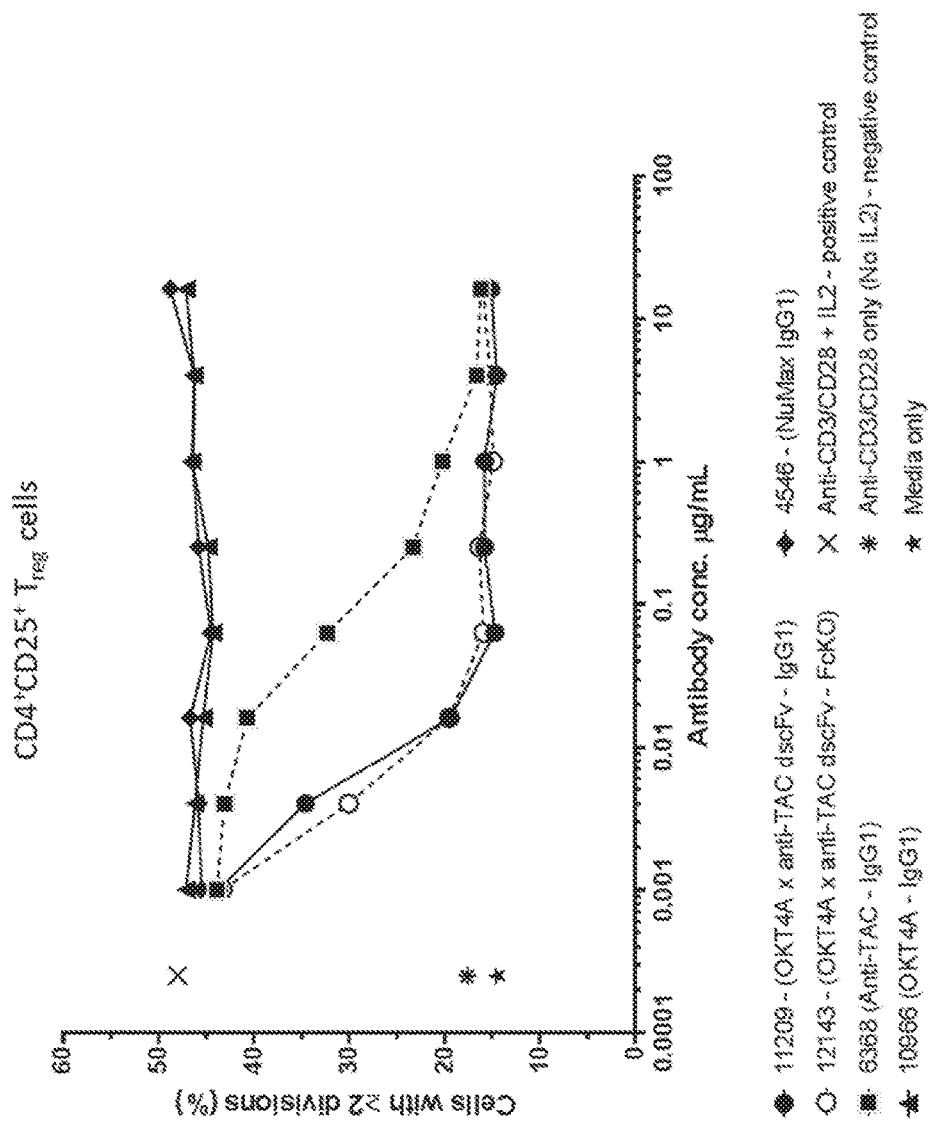
FIG. 5. Suppression of Treg cells by anti-CD4× anti-CD25 bispecifics. Proliferation of Tregs was assayed using CFSE in the presence of bispecific or control antibodies with 15 U/mL IL2.

"Common light-chain" anti-CD4×CD25 bispecific antibodies were constructed by co-transfecting (in 293E cells) DNA encoding the heavy chain of anti-CD4 antibody OKT4A_H0L0 with the heavy chain of anti-CD25 antibody HuMAX-Tac and the light chain of anti-CD4 antibody OKTH0L0. These bispecific antibodies express well and have biophysical properties equivalent to normal monovalent IgG antibodies. Utilizing a heterodimeric Fc format, dual scFv-Fc anti-CD4×CD25 bispecific antibodies were also constructed and expressed. A third format, with a normal Fab-Fc on one side and scFv-Fc on the other side was also constructed. Control "one-armed" antibodies were also constructed to evaluate the effects of monovalent antigen binding (e.g. Anti-CD4× empty-Fc or Anti-CD25 by empty-Fc). For all three formats, variants with different Fc regions were produced: IgG1, high ADCC (S239D/I332E), and Fc knockout (G236R/L328R or PVA_/S267K). Bispecific formats are shown schematically in FIG. 3. These bispecific antibody variants were evaluated for the ability to simultaneously bind both CD4 and CD25 on Biacore. 100 nM of each variant was bound to a CD25 surface, followed by flowing of 100 nM of CD4 over the chip surface. An example of the data is shown in FIG. 4.

Although CD4 and CD25 antigens were initially targeted for suppressing Tregs, other combinations of Treg markers may also be used in accordance with the methods described herein, including combinations listed in FIG. 32. Anti-CTLA4× Anti-CD25, Anti-PD-1× Anti-CD25, and Anti-CCR4× Anti-CD25 bispecific antibodies were also constructed. Any of the formats shown in FIG. 3 can be made to bind to any combinations of the targets listed in FIG. 32.

Example 2. Suppression of Regulatory T Cells with Anti-CD4× Anti-CD25 Bispecific Antibodies Treg cells were generated in vitro using the following method. $CD4^+$ enriched T cells (isolated using the EasySep™ Human $CD4^+$ T Cell Enrichment Kit from Stemcell Technologies) from PBMC were incubated with anti-CD3/anti-CD28 beads (20 µl beads in 100 µl volume, or 4:1 beads to cell ratio using Dynabeads® Regulatory $CD4^+CD25^+T$ Cell Kit) with 500 U/mL of IL2 in the presence of 0.1 µg/ml rapamycin for a week. Cells were replaced with new culture with anti-CD3 (OKT3, eBiosciences) plate bound at 0.5 µg/mL and soluble 0.5 µg/mL anti-CD28 (clone 28.2, eBiosciences) with 100 U/mL of IL2 and 0.1 µg/mL rapamycin.

Figure 13:
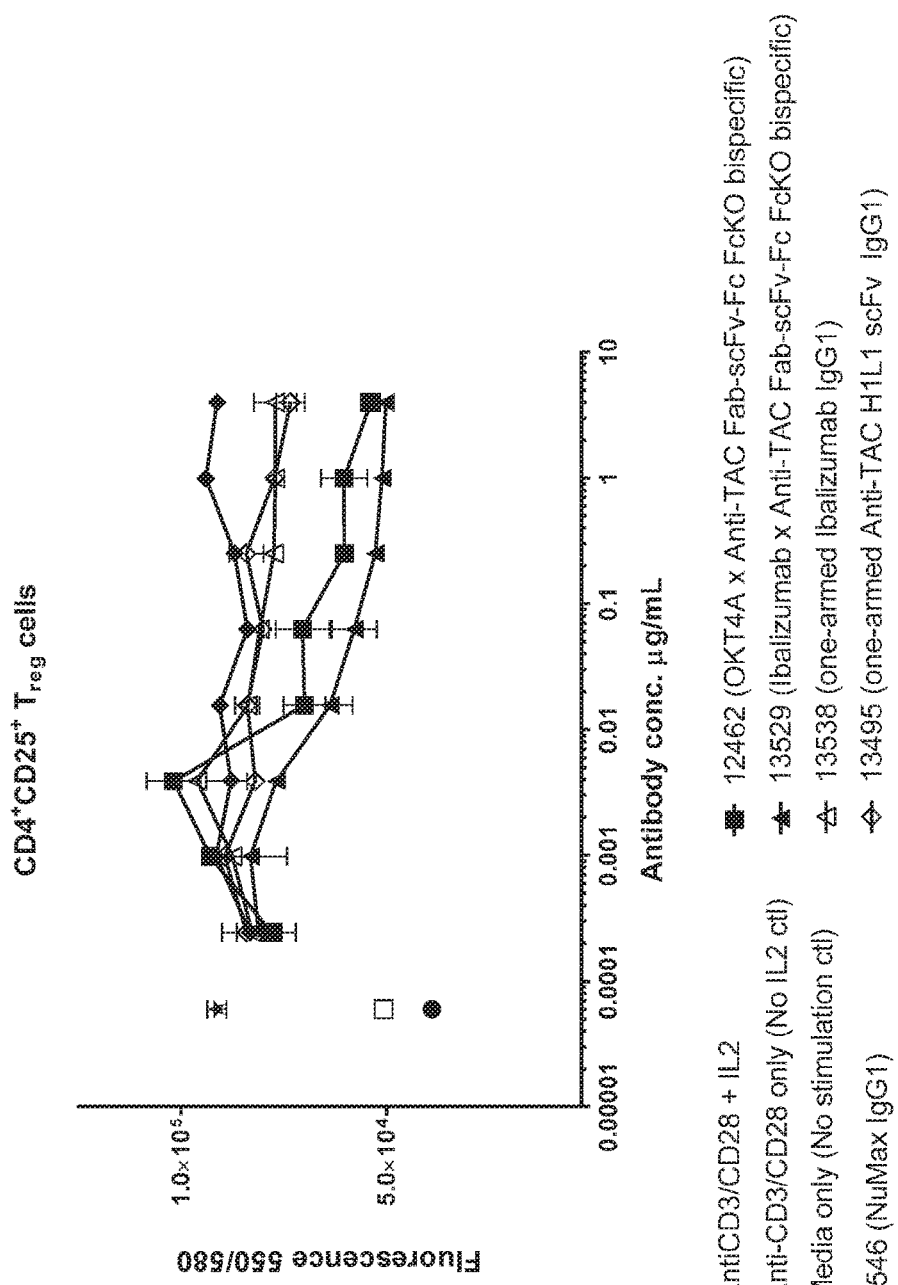
FIG. 13. Suppression of Treg cells by anti-CD4× anti-CD25 bispecifics. Proliferation of Tregs was assayed using Alamar Blue in the presence of bispecific or control antibodies with 15 U/mL IL2.
Figure 14:
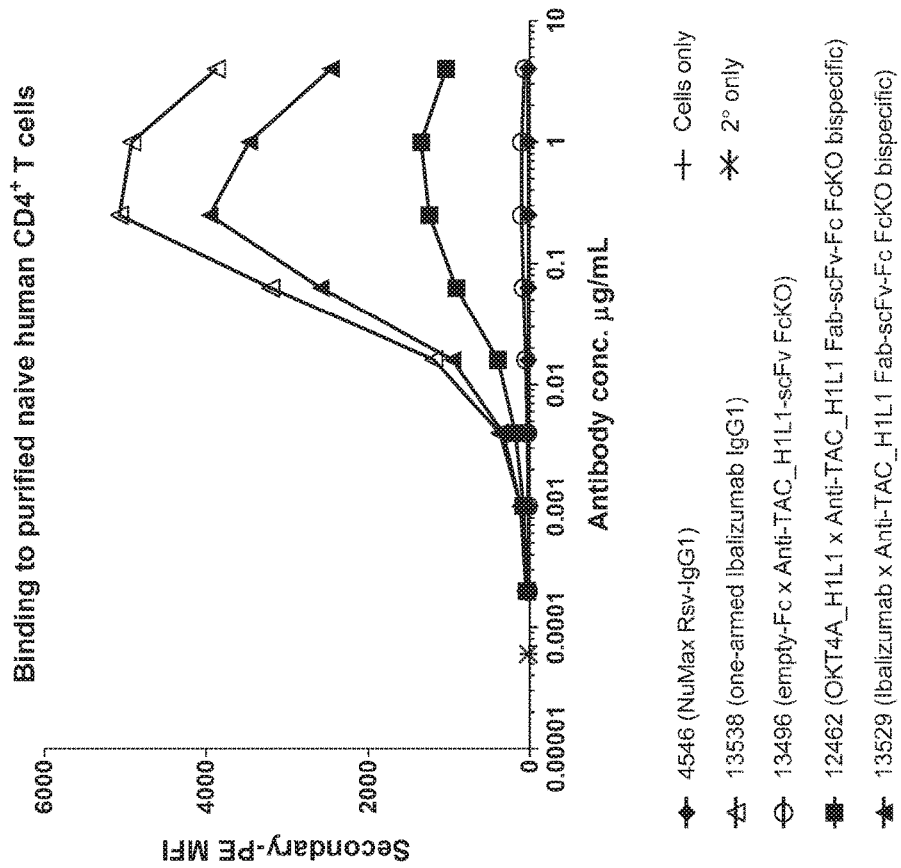
FIG. 14. Binding of anti-CD4× anti-CD25 bispecifics and control antibodies to purified naïve human CD4+ T cells.

Proliferation of Treg cells was assayed using CFSE cell proliferation assay or Alamar Blue cell viability assays in the presence of bispecific or control antibodies with 15 U/mL IL2. Results are shown in FIG. 5, FIG. 7, FIG. 12, FIG. 13, and FIG. 15. Anti-CD4× Anti-CD25 bispecifics 11209 and 12143 (IgG1 and FcKO Fc, respectively) were able to suppress proliferation of Treg cells more strongly compared to anti-CD25 (6368) antibody alone, and no effect was seen with anti-CD4 mAb (10966) alone. These results demonstrate the increased suppression of Treg cells with avid targeting using anti-CD4× anti-CD25 bispecific antibodies. The Fv of OKT4A was also humanized (OKT4A_H1L1) using the method of Lazar et al., 2007, Molecular Immunology, 44:1986-1998, hereby incorporated by reference in its entirety for all purposes and in particular for all teachings related to OKT4A, and this Fv was tested (FIG. 12 and FIG. 15), along with bispecifics containing the alternative anti-CD4 Fv Ibalizumab (FIG. 13). The epitopes of OKT4A and Ibalizumab differ, with binding of OKT4A to CD4 expected to block MHC II binding to CD4 whereas the epitope of Ibalizumab is away from the MHC II binding site on CD4 and its binding is not expected to be blocking. The precursor murine Fv of Ibalizumab (5A8) was also humanized to generate 5A8_H1L1. Bispecifics with the anti-CD4 Fv 5A8_H1L1 were also generated.

Figure 8:
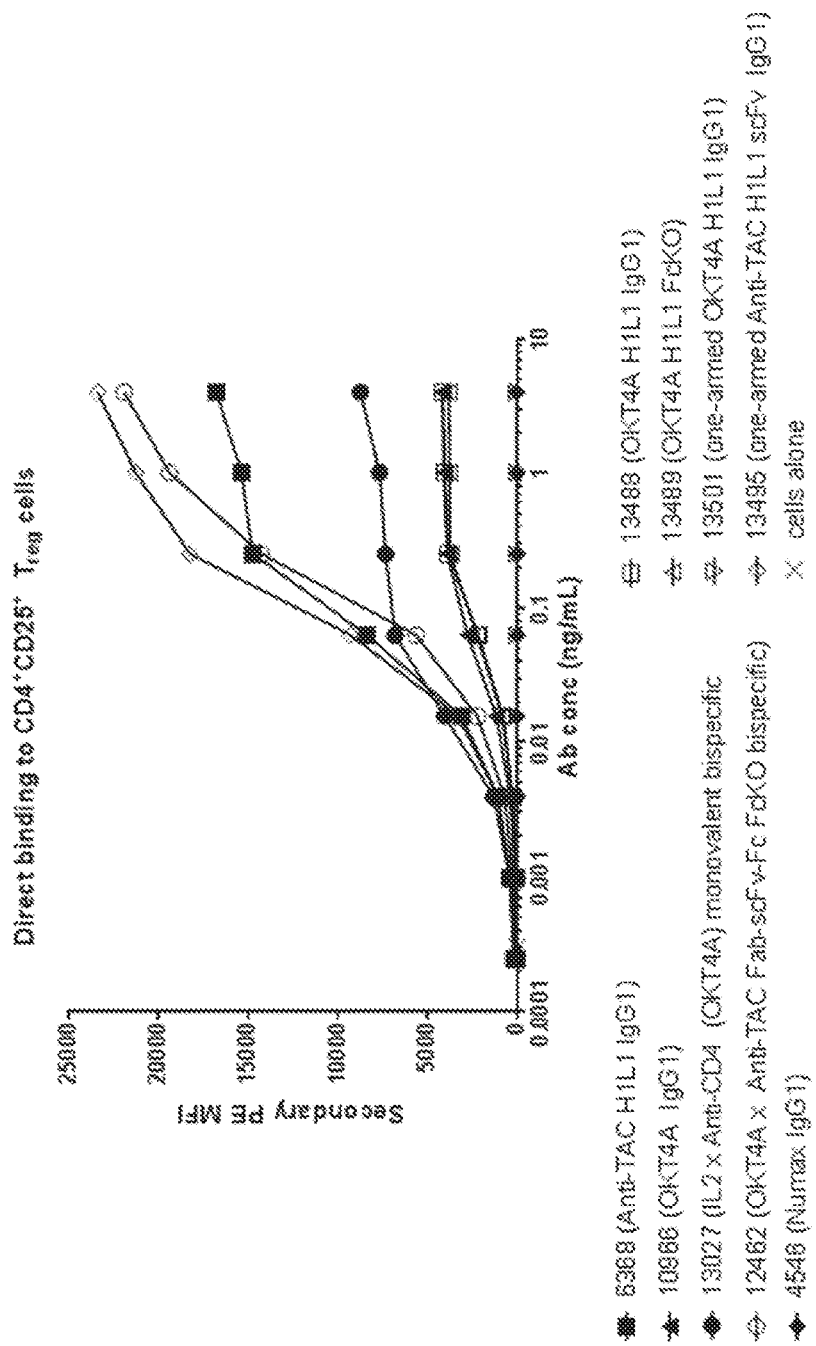
FIG. 8. Direct binding of anti-CD4× anti-CD25 bispecifics and control antibodies on Treg cells.
Figure 15:
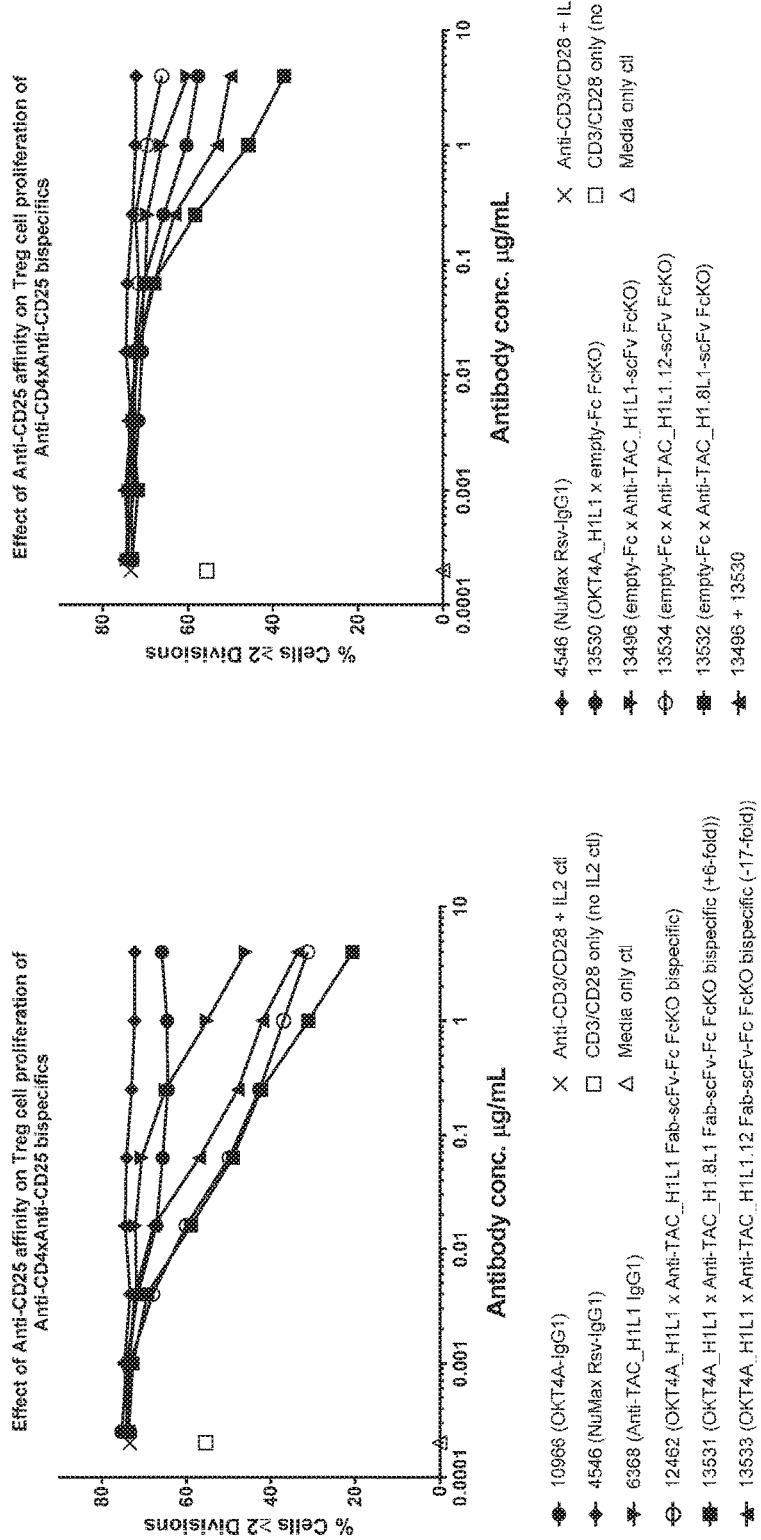
FIG. 15. Effect of altering CD25 binding affinity on suppression of Treg cells by anti-CD4× anti-CD25 bispecifics. Proliferation of Tregs was assayed using CFSE in the presence of bispecific or control antibodies with 15 U/mL IL2.
Figure 16:
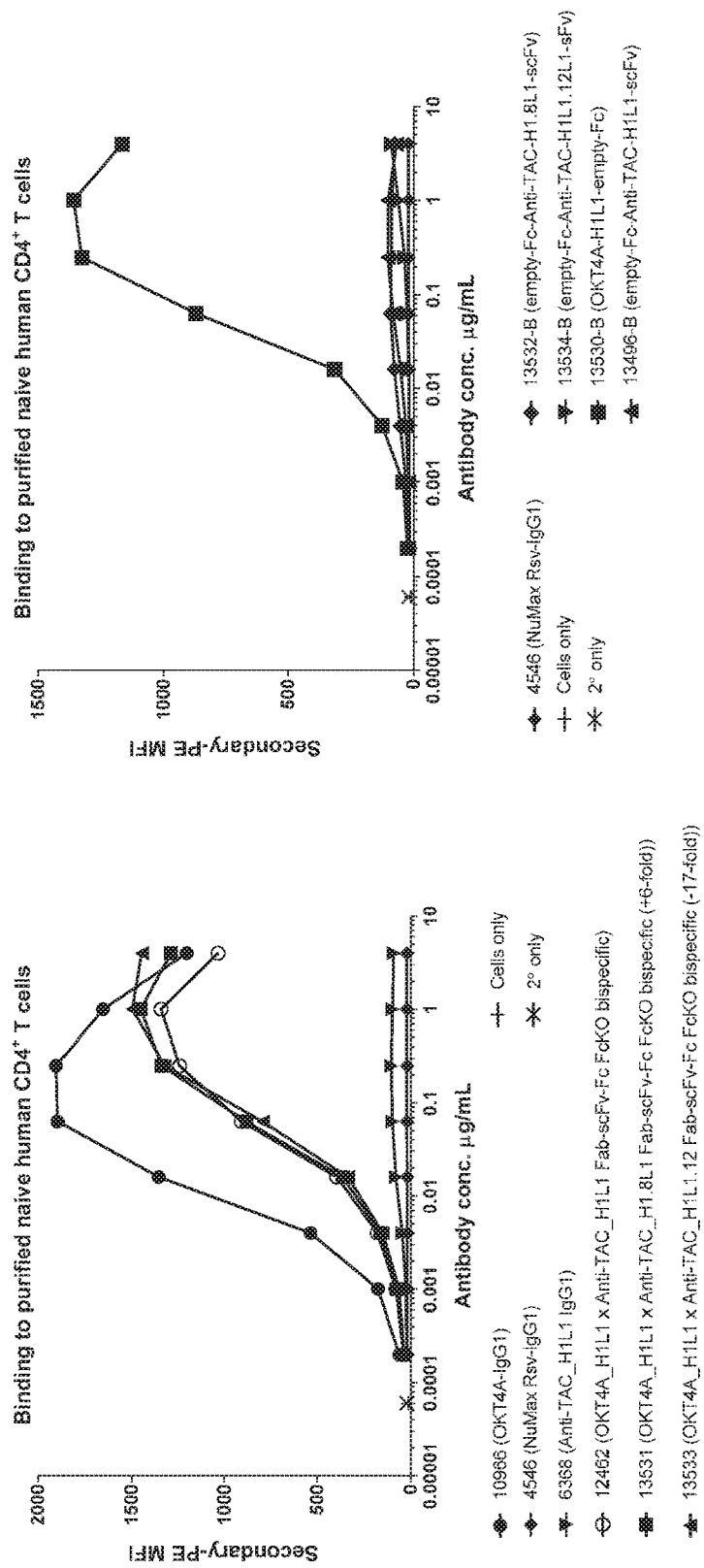
FIG. 16. Direct binding of altered CD25 affinity anti-CD4× anti-CD25 bispecifics to purified naïve human CD4+ T cells.
Figure 17:
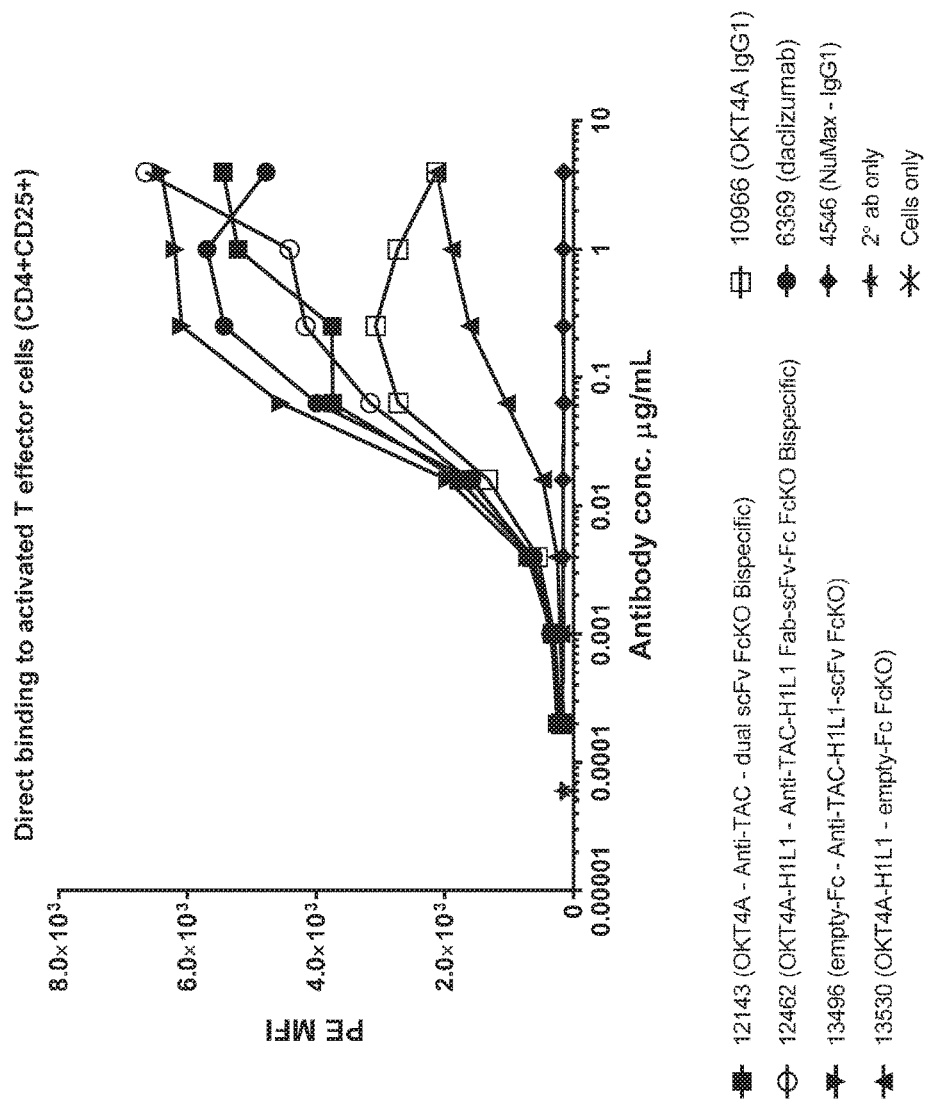
FIG. 17. Direct binding of anti-CD4× anti-CD25 bispecifics and controls to activated T effector cells (CD4+CD25+).
Figure 18:
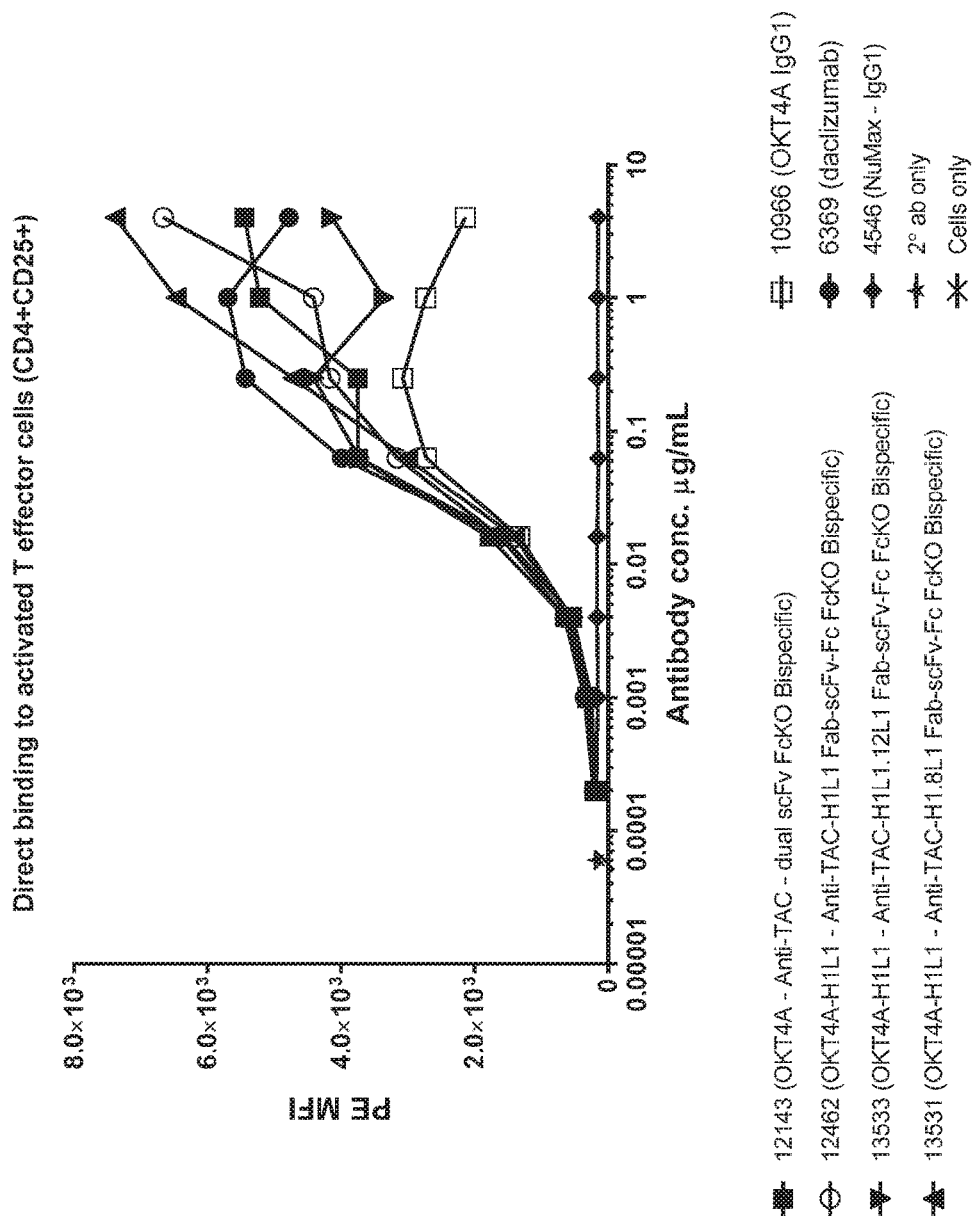
FIG. 18. Direct binding of altered CD25 affinity anti-CD4× anti-CD25 bispecifics to activated T effector cells (CD4+CD25+).
Figure 19:
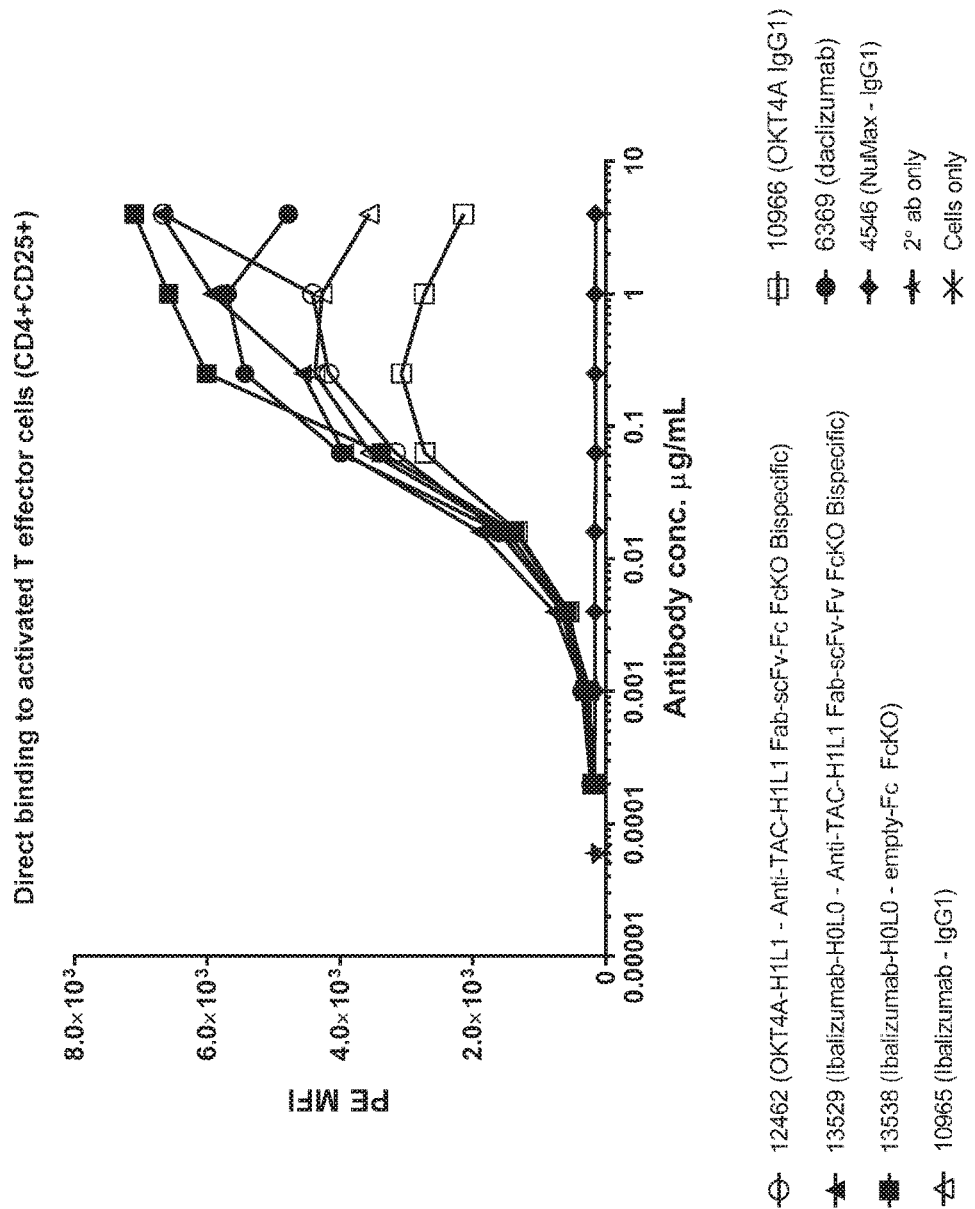
FIG. 19. Direct binding of anti-CD4× anti-CD25 bispecifics and controls to activated T effector cells (CD4+CD25+).

Example 3. Effect of Altering Antigen Binding Affinity of Anti-CD4× Anti-CD25 Bispecific Antibodies Variant bispecific antibodies and one-armed antibody controls were constructed in which the CD25 binding affinity was altered. The Anti-TAC_H1.8L1 Fv (in 13531 and 13532) has 6-fold increased affinity for CD25. Conversely, the Anti-TAC_H1L1.12 Fv (in 13533 and 13534) has 17-fold lower CD25 affinity. These variants were assessed in cell proliferation assays (FIG. 15). A clear correlation between CD25 affinity and potency can be seen. 13531 with increased CD25 affinity has the strongest inhibition of cell proliferation, while lower affinity resulted in a reduced effect on cell proliferation. A similar pattern is also expected if CD4 affinity was altered. However, increasing the affinity for CD4 may result in even greater potency on Tregs due to its lower expression level compared to CD25. This can be shown by lower binding of anti-CD4 mAbs on Tregs compared to anti-CD25 mAbs (shown in FIG. 8).

Example 4. Direct Binding of Anti-CD4× Anti-CD25 Bispecific Antibodies to Tregs and Naïve CD4+ T Cells Binding of Anti-CD4× anti-CD25 bispecifics and control antibodies was measured to Tregs, naïve CD4+ T cells, and activated CD4+ and CD8+ T cells. 200 k Tregs were plated with antibodies at 4 µg/mL (4× serial dilutions, 8 total dilutions). Cells and Abs were incubated at 45 min on ice and then washed and stained with secondary Ab anti-human F(ab)'2 Fcgamma specific PE labeled at 1 µg/mL. Cells were washed and fixed with 1% PFA overnight and data acquired on a FACS Canto II. Results are shown in FIGS. 8-11. Bispecifics and anti-CD25 mAbs bound more strongly to Tregs compared to anti-CD4 mAbs, indicating that there may be a higher density of CD25 on Tregs compared to CD4. A clear avidity effect was seen with the bispecifics. Direct binding to purified naive human CD4+ T cells, activated CD4+, and activated CD8+ T cells was also assessed in a similar manner. Results for these binding assays are shown in FIG. 14 and FIGS. 16-22.

Example 5. Effect of Anti-CD4× Anti-CD25 Bispecific Antibodies on Cell Proliferation of CD4+CD25+ (Helper T Cells) and CD8+CD25 Cytotoxic T Cells)

Figure 6:
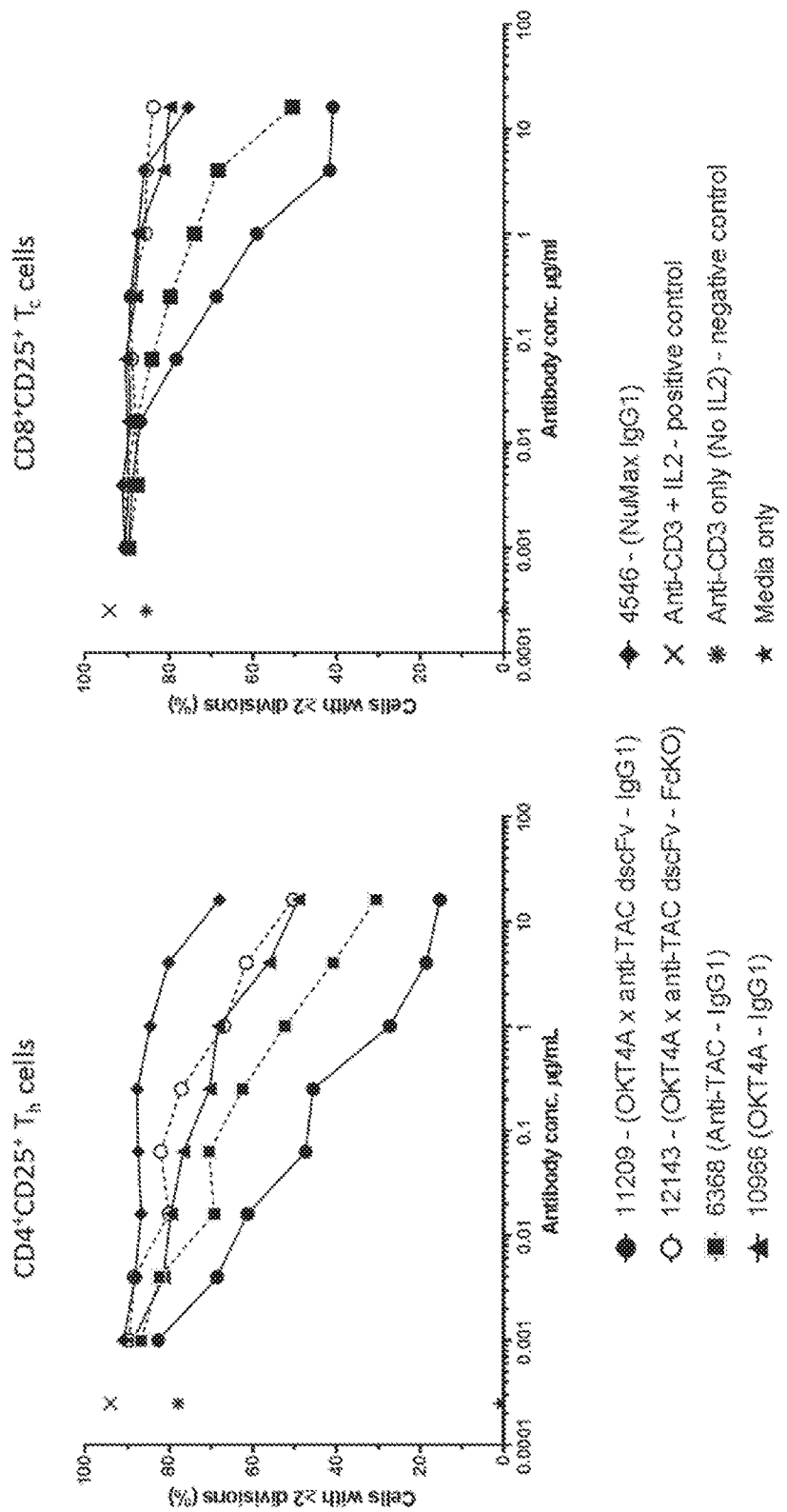
FIG. 6. Effect of anti-CD4× anti-CD25 bispecifics on helper (CD4$^+$CD25$^+$) and cytotoxic (CD8$^+$CD25$^+$) T cell populations.
Figure 7:
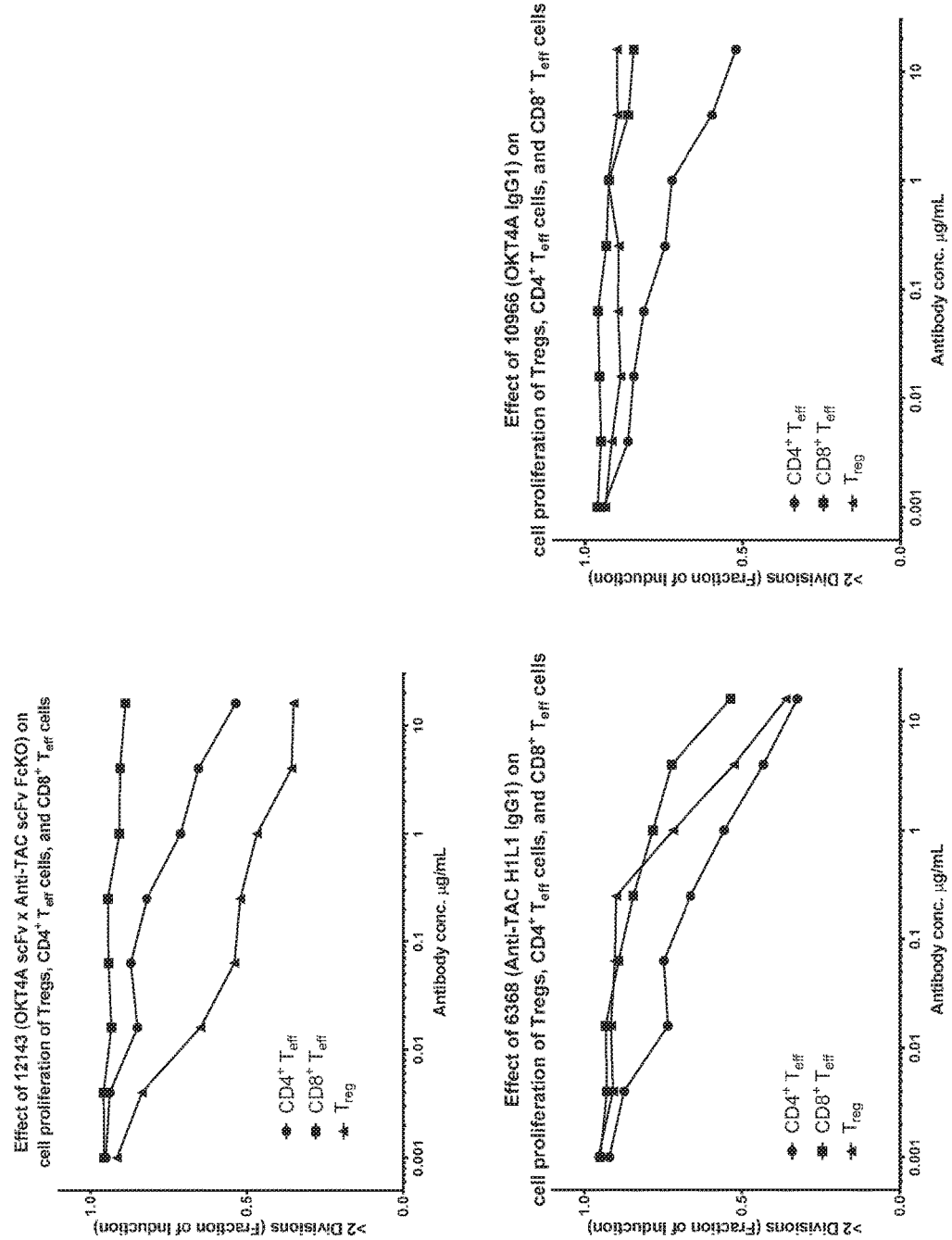
FIG. 7. Effect of bispecific antibodies and control anti-CD25 and anti-CD4 antibodies on cell proliferation of Tregs, CD4+ T-effectors, and CD8+ T-effectors. Bispecific antibody 12143 has higher potency on Tregs compared to controls as well as lower potency compared to controls on unwanted suppression of T effector cells.

For suppression of Tregs, it is desirable to suppress Treg cells and have little or no impact on other T cell types. To assess the impact of Anti-CD4× Anti-CD25 bispecific antibodies on other T cell types, CFSE labeled PBMC were incubated with 12.5 ng/mL anti-CD3 and 15 U/mL IL2 for 4 days in the presence of bispecific or control antibodies. Results are shown in FIG. 6 and FIG. 7. In this format, a clear dependence on FcγR binding ability is seen. 11209—Anti-CD4× Anti-CD25 IgG1 causes suppression of T-helper cells, while 12143—Anti-CD4× Anti-CD25 FcKO has a much reduced level of suppression. Anti-CD25 (6368) antibody alone is also able to cause suppression of this T cell type, while anti-CD4 mAb (10966) alone shows limited activity (both are IgG1 Fc).

For cytotoxic T cells ($CD8^+CD25^+$), suppression was only seen with 11209—Anti-CD4×CD25 IgG1 and Anti-CD25 (6368). No suppression was seen with 12143—Anti-CD4× Anti-CD25 FcKO or anti-CD4 mAb (10966). Again, a clear dependence on FcγR binding ability of the bispecifics is seen.

Example 6. Constructing Bispecific Anti-CD4×IL2 Fc-Fusions

Figure 24:
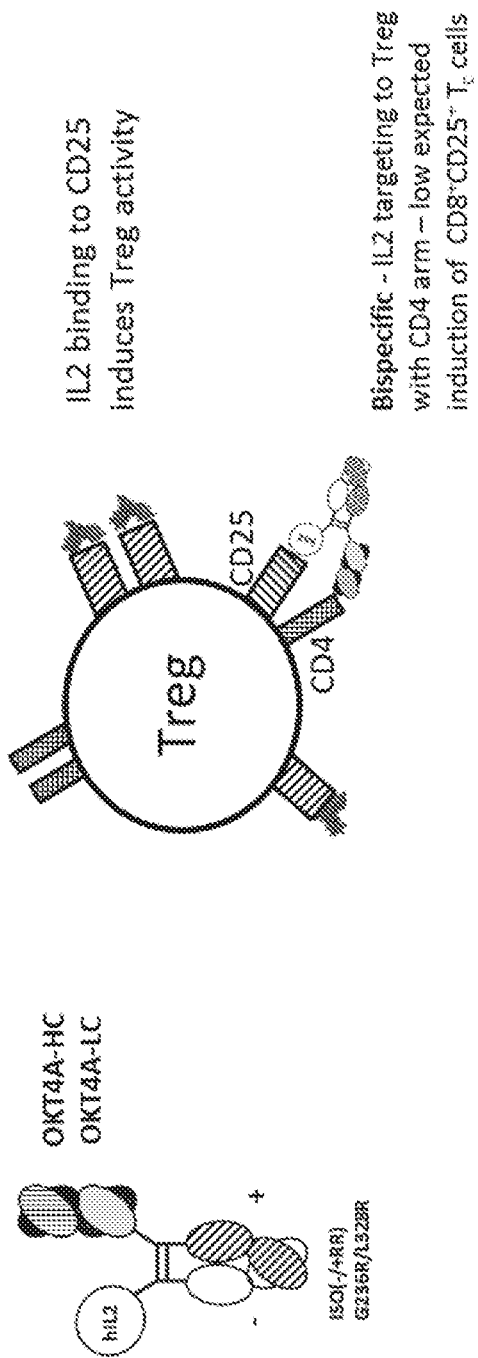
FIG. 24. Diagram illustrating induction of Treg cells with anti-CD4×IL2 Fc-fusions. An example construct is also shown.

The concept of inducing Treg cells with anti-CD4×IL2 Fc-fusions while not affecting other T cell types is shown schematically in FIG. 24.

Figure 25:
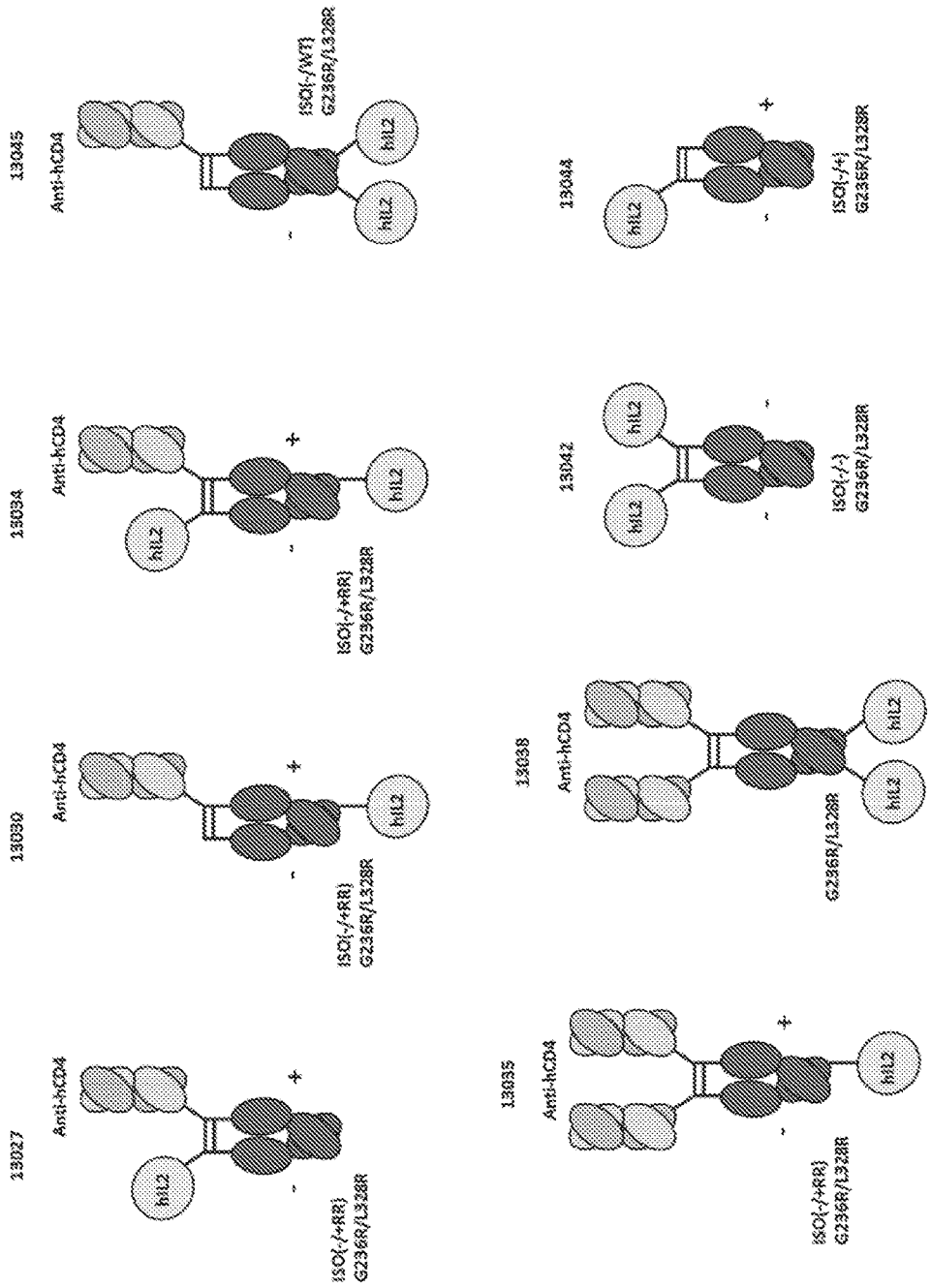
FIG. 25. Exemplary IL2 Fc-fusions and bispecific antibody-IL2 Fc-fusions for induction of Tregs.
Figure 26:
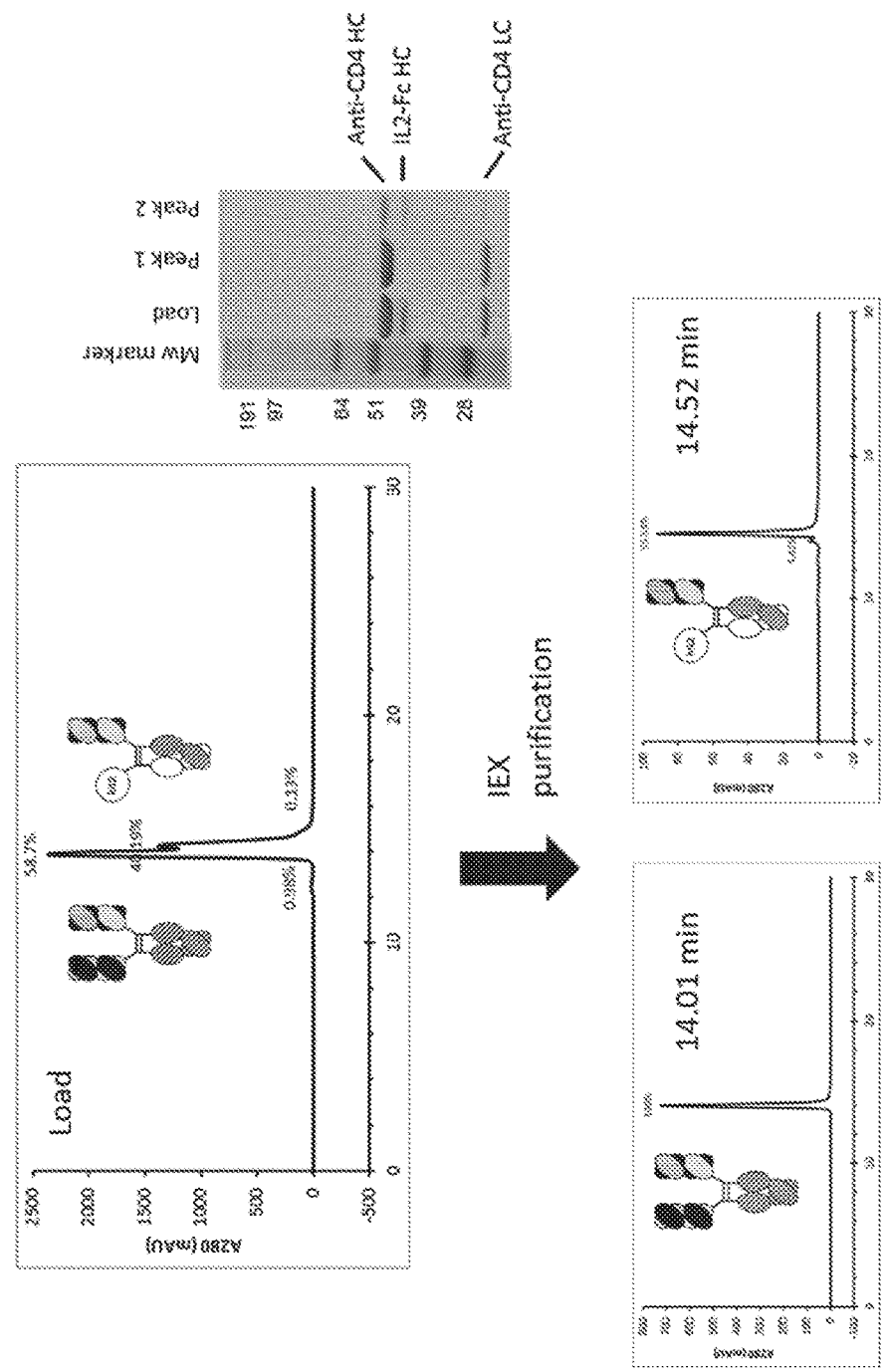
FIG. 26. Purification and analysis of anti-CD4×IL2 Fc-fusions. Fc-fusions are purified by Protein A and IEX chromatography, and purity assessed by SEC and SDS-PAGE.

Anti-CD4×IL2 Fc-fusions were designed and constructed from the sequences of human IL2 and the anti-CD4 antibody OKT4A (FIG. 25). Constructs in the pTT5 vector were expressed in 293E cells and purified using Protein A and IEX chromatography to isolate the desired heterodimeric Fc-fusion. SEC and SDS-PAGE analysis of the Protein A purified material as well as the final IEX purified material are shown in FIG. 26. Anti-CD4×IL2 Fc-fusions were homogeneous and obtained in high purity. All Fc-fusions were expressed with a FcγR knocked out binding Fc region (IgG1 G236R/L328R or IgG1 PVA_/S267K). Anti-CD4× IL2 Fc-fusions using the Anti-CD4 mAbs Ibalizumab and 5A8_H1L1 were also constructed, as were Anti-CCR4×IL2, Anti-CTLA4×IL2, and Anti-PD1×IL2 antibody Fc-fusions. Bispecific IL2 Fc-fusions with antibodies against any of the Treg markers listed in Table 1 could also be constructed. Alternatively, similar variants may possess superior selectivity for Treg agonism versus other T cell types.

Example 7. Induction of Regulatory T Cells (Tregs) by Anti-CD4×IL2 Fc-Fusions

Treg cells were generated in vitro using the following method. CD4+ enriched T cells (isolated using the EasySep™ Human CD4+ T Cell Enrichment Kit from Stemcell Technologies) from PBMC were incubated with anti-CD3/anti-CD28 beads (20 µl beads in 100 µl volume, or 4:1 beads to cell ratio using Dynabeads® Regulatory CD4$^+$CD25$^+$T Cell Kit) with 500 U/mL of IL2 in the presence of 0.1 µg/mL rapamycin for a week. Cells were replaced with new culture with anti-CD3 (OKT3, eBiosciences) plate bound at 0.5 µg/mL and soluble 0.5 µg/mL anti-CD28 (clone 28.2, eBiosciences) with 100 U/mL of IL2 and 0.1 µg/mL rapamycin.

Figure 27:
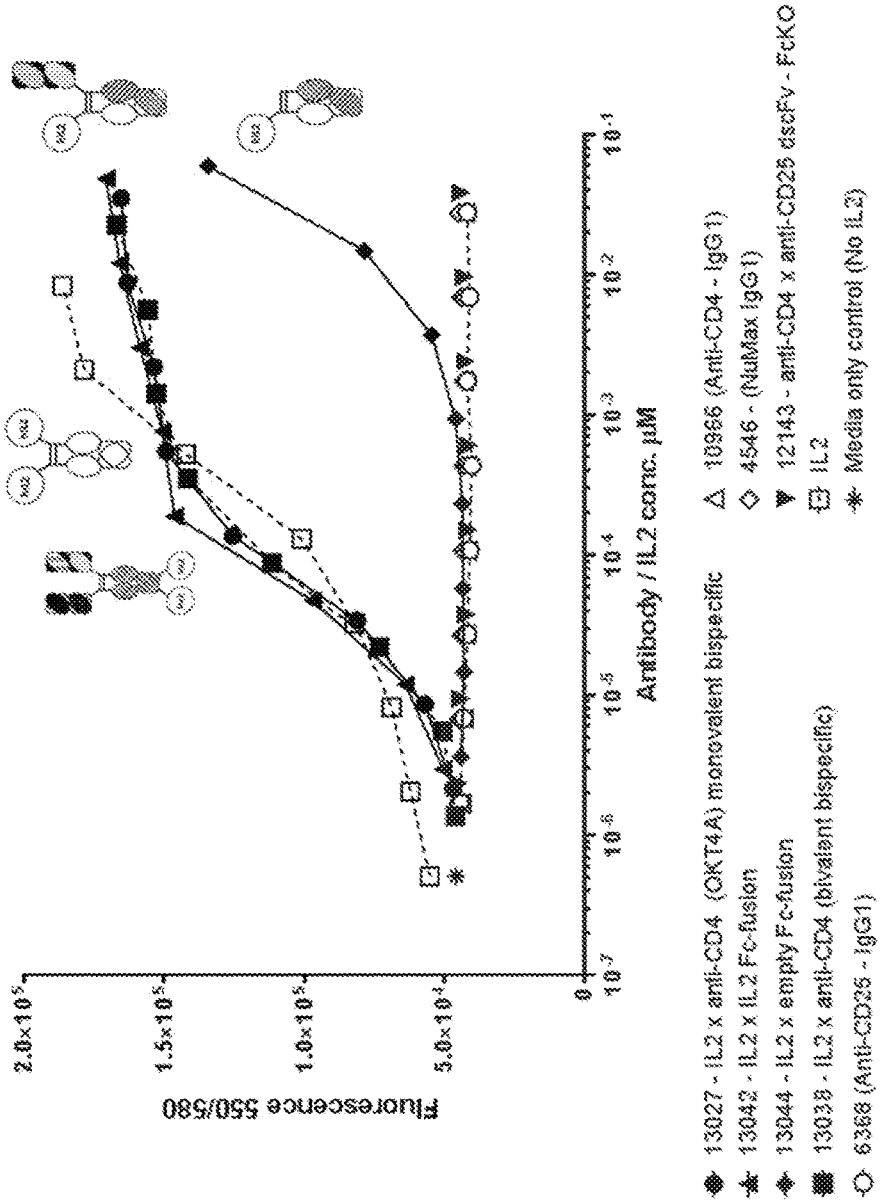
FIG. 27. Induction of regulatory T cells (Tregs) by anti-CD4×IL2 Fc-fusions. Induction of Tregs was assayed using the alamar blue cell viability assay in the presence of anti-CD4×IL2 Fc-fusions or control antibodies.

Induction of Treg cells was assayed using the alamar blue cell viability assay in the presence of anti-CD4×IL2 Fc-fusions or control antibodies. Results are shown in FIG. 27. Increased viability of Treg cells was seen for the anti-CD4× IL2 Fc-fusions as well as IL2-only Fc-fusions. Anti-CD25 and anti-CD4 control antibodies showed no induction. The IL2-only Fc fusion (13044) served as a proxy for the reduced level of induction expected for cytotoxic T cells (CD8$^+$ CD25$^+$).

Example 8. Suppression or Induction of Regulatory T Cells Using Anti-CD4×IL2 Fc-Fusions Engineered for Reduced or Increased IL2-Receptor Signaling IL2 are engineered in order to alter the ratio of induction for Treg cells versus other types of IL2 receptor expressing cells (i.e. NK cells). For example, a dominant-negative IL2 Fc-fusion is created by engineering IL2 to have reduced ability to bind to IL2Rβ, IL2Rγ, and or IL2Rα in order to ablate IL2 receptor signaling. When coupled with an anti-CD4 antibody (or other Treg surface marker antibody), this results in an anti-CD4×IL2 Fc-fusion capable of suppressing Treg cells through targeted binding to CD4 and CD25, but without the ability to induce Treg proliferation. This Fc-fusion blocks endogenous IL2 from binding to receptor.

Likewise, more potent Anti-CD4×IL2 Fc-fusions inducers are engineered by increasing the affinity of IL2 for IL2Rα. Exemplary variants of IL2 of use in the present invention are listed in FIG. 23.

Figure 28:
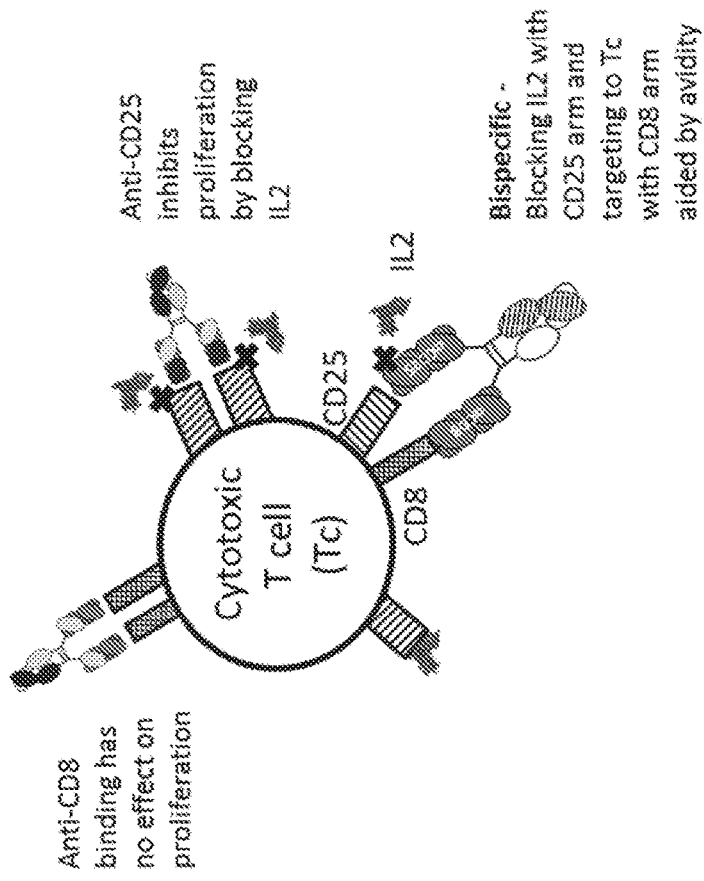
FIG. 28. Diagram illustrating suppression of activated cytotoxic (CD8$^+$CD25$^+$) T cells by anti-CD8× anti-CD25 bispecific antibodies.
Figure 29:
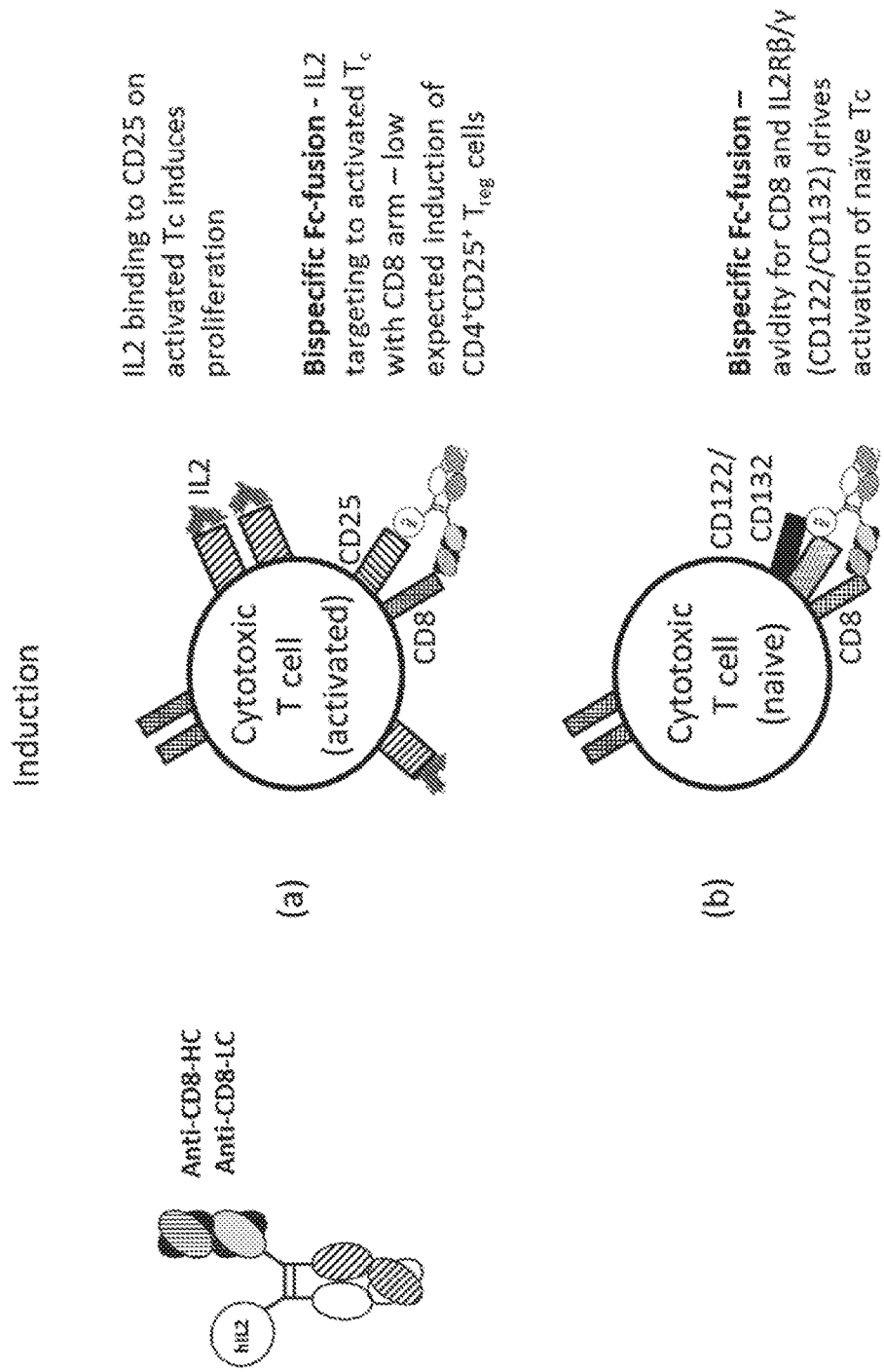
FIG. 29. Diagram illustrating induction of naïve and activated cytotoxic (CD8$^+$CD25$^+$) T cells by anti-CD8×IL2 Fc-fusions.
Figure 36A:
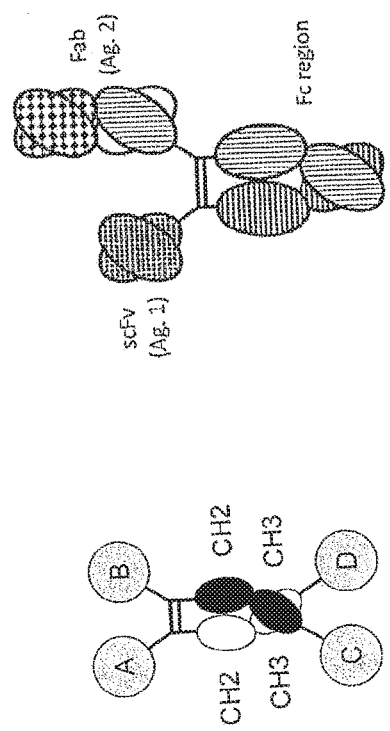
FIG. 36A-36M. Illustration of a number of heterodimeric protein formats, including heterodimeric Fc fusion proteins as well as heterodimeric antibodies.
Figure 36B:
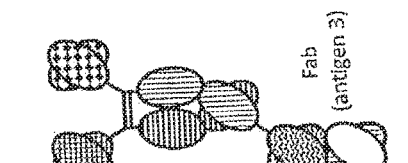
Figure 36C:
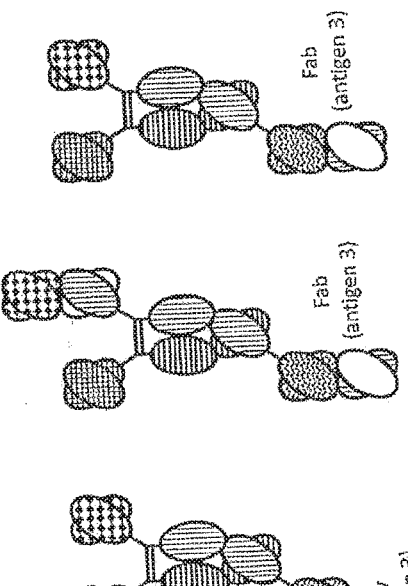
Figure 36D:
Figure 36E:
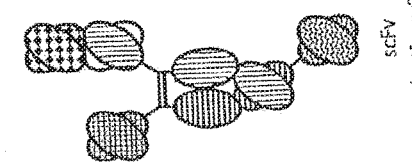
Figure 36F:
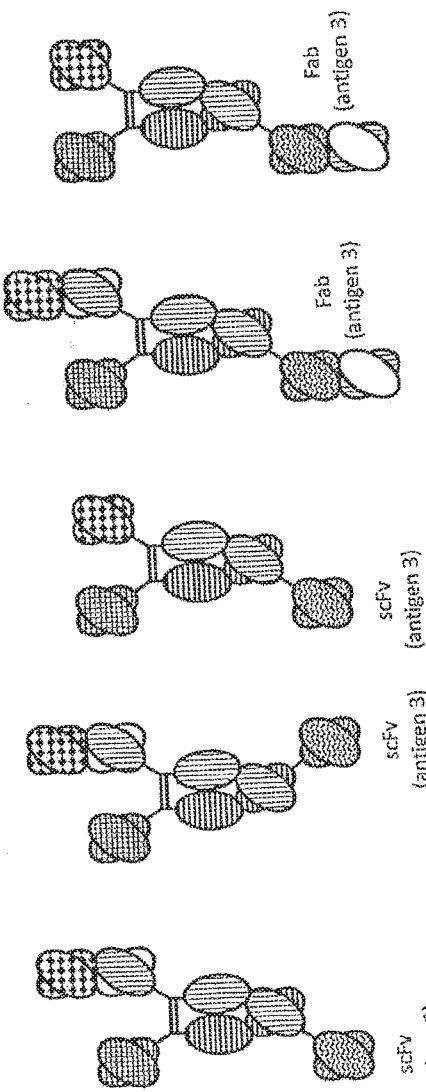
Figure 36G:
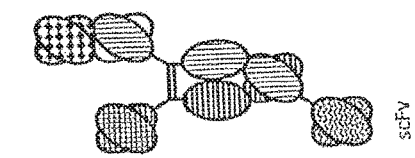
Figures 36H, 36I, 36J, 36K, 36L, 36M:
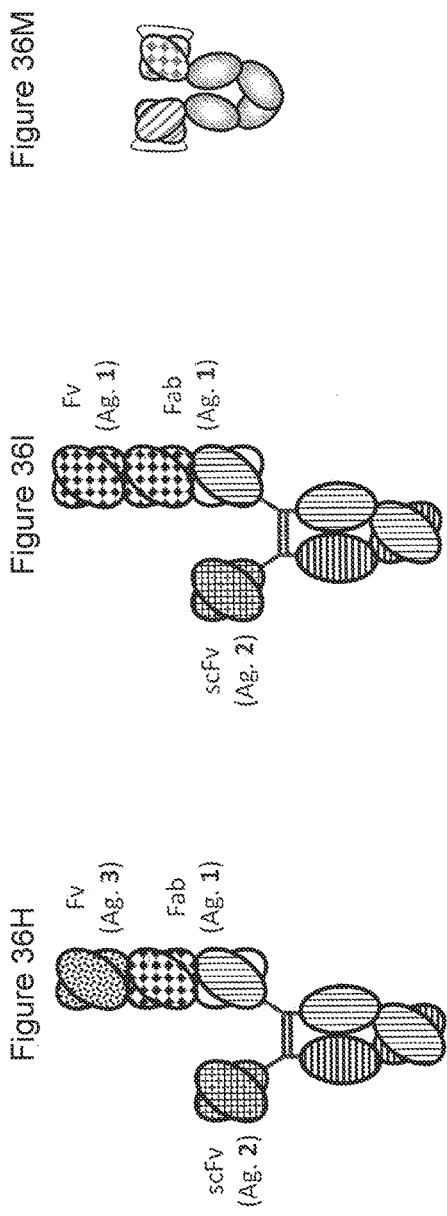

Example 9. Suppression and Induction of Cytotoxic T Cells with Anti-CD8× Anti-CD25 Bispecific Antibodies or Anti-CD8×IL2 Fc-Fusions Anti-CD8 antibodies including MCD8, 3B5, SK1, OKT-8, 51.1 or DK-25 are combined with an anti-CD25 antibody to make a bispecific antibody for suppression of cytotoxic T cells. Alternatively, in order to induce cytotoxic T cells, an Fc-fusion consisting of IL2 combined with an anti-CD8 antibody are used. Avidity may also drive IL-2 activation by binding the low affinity (beta/gamma) IL-2 receptor, circumventing the requirement for CD25, thus also being effective on non-activated CD8. Methods for suppression and induction are shown schematically in FIG. 28 and FIG. 29. These approaches are useful for treating cancer or autoimmune diseases, respectively.

Example 10. Evaluation of Treg Suppressor and Inducer Variants in a GVHD Mouse Model Variants of the invention are evaluated in a Graft-versus-Host Disease model conducted in NSG SCID mice such as those conducted in Mutis et al., Clin Cancer Res (12), 2006. When NSG SCID mice are injected with human PBMCs they develop an autoimmune response against the human PBMCs, and this has been shown to be Treg dependent. NSG SCID mice injected with human PBMCs and then treated with a Treg suppression bispecific antibody such as 12143, 12462, 13025, or 13529 will have an exacerbation of disease and will die more quickly compared to untreated mice. Conversely, mice can be given a Treg inducing bispecific IL2-Fc fusion such as 13027 and they have a less severe disease and live longer than untreated mice.

Example 11. Evaluation of Treg Suppressor Mouse Surrogate Variants in Syngeneic Mouse Tumor Models Mouse surrogate bispecific antibodies and IL2-Fc fusions can be made and studied in syngeneic mouse tumor models. The Treg suppressor bispecific Anti-mCD4× Anti-mCD25 can be made using the Anti-mouse CD4 antibody GK1.5 and the Anti-mouse CD25 antibody PC61. Tumors can be introduced in normal mice and then the mice treated with surrogate bispecific antibody. Suppression of the mouse Tregs should allow the mouse cytotoxic T cells to fight the tumor, resulting in a decreased tumor volume.

Example 12. Evaluation of Treg Inducer Mouse Surrogate Variants in an EAE Mouse Model Mouse surrogate Treg inducer IL2-Fc fusion bispecifics can be created by using human IL2 with an anti-mouse CD4 antibody such as GK1.5. Human IL2 is known to bind to the mouse IL2 receptor. Experimental autoimmune encephalomyelitis (EAE) is a mouse model of autoimmunity. Mice can be induced for EAE and then treated with mouse surrogate Anti-mCD4×IL2 bispecific Fc-fusions. Induction of mouse Tregs should result in less severe disease.

All cited references are herein expressly incorporated by reference in their entirety.

Whereas particular embodiments have been described above for purposes of illustration, it will be appreciated by those skilled in the art that numerous variations of the details may be made without departing from the invention as described in the appended claims.

Example 13. Constructing Anti-Treg Bispecific Antibodies

The bispecific antibody constructs for targeting Treg cells while not affecting other T cell types is shown schematically in FIG. 49.

Desired gene segments were synthesized by Blue Heron Biotechnologies (Bothell, Wash.) from synthetic oligonucleotides and PCR products by automated gene synthesis. Antibody constructs in the pTT5 vector were expressed in 293E cells and purified by standard Protein A, followed by IEX chromatography in order to isolate the desired heterodimeric bispecific.

The preferred bispecific format, with a normal Fab-Fc on one side and scFv-Fc on the other side was constructed. Variants with different Fc regions were produced: IgG1, high ADCC (S239D/I332E), and Fc knockout (G236R/L328R or PVA/S267K).

Example 14. Depletion of Regulatory T Cells with Anti-CD4×CD25, Anti-CCR4×CD25, Anti-CTLA4×CD25 and Anti-CCR4×CTLA4 Bispecific Antibodies Unactivated peripheral blood mononuclear cells (PBMCs) were cultured overnight at 37° C. The following day, $3 \times 10^6$ cells in a volume of 200 μL were cultured in the presence of different concentrations (usually 4–0.0012 ug/mL in 5-fold dilutions) of bispecific antibody for 24 hr. If activated PBMCs were used, cells were first activated with 0.2 ug/mL anti-CD3 for 3 days.

Figure 52:
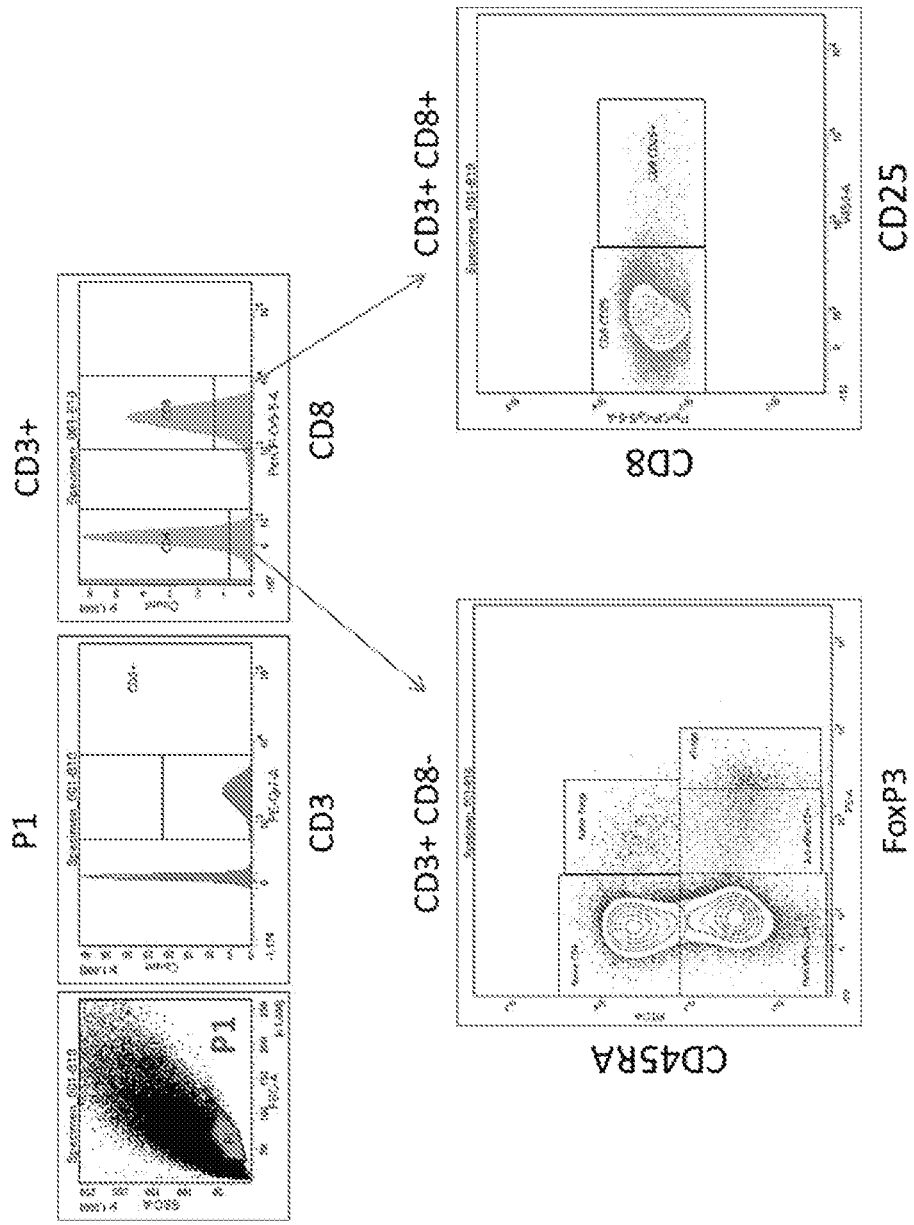
FIG. 52. Gating strategy used for analyzing depletion of T cell populations in non-activated PBMC by Treg depleting bispecific antibodies.
Figure 53:
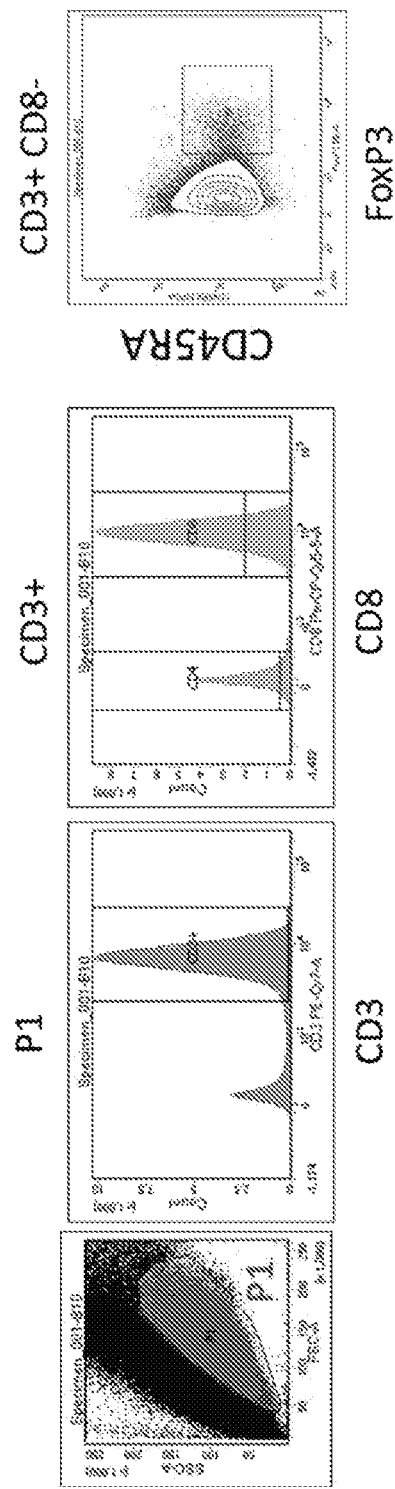
FIG. 53. Gating strategy used for analyzing depletion of T cell populations in activated PBMC by Treg depleting bispecific antibodies.
Figure 54:
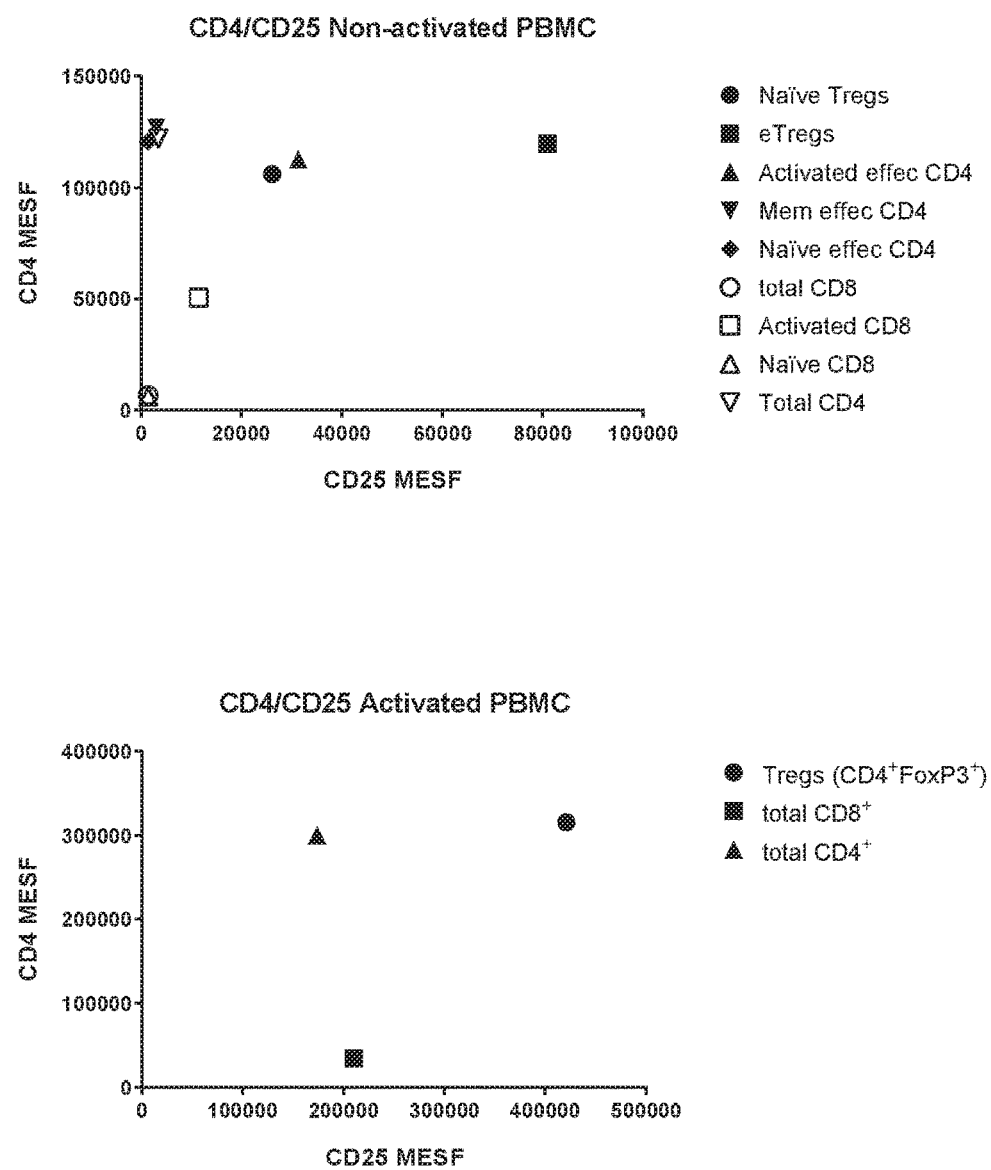
FIG. 54. MESF antigen density of CD4 and CD25 on different populations of T cells in non-activated and activated PBMC.
Figure 55:
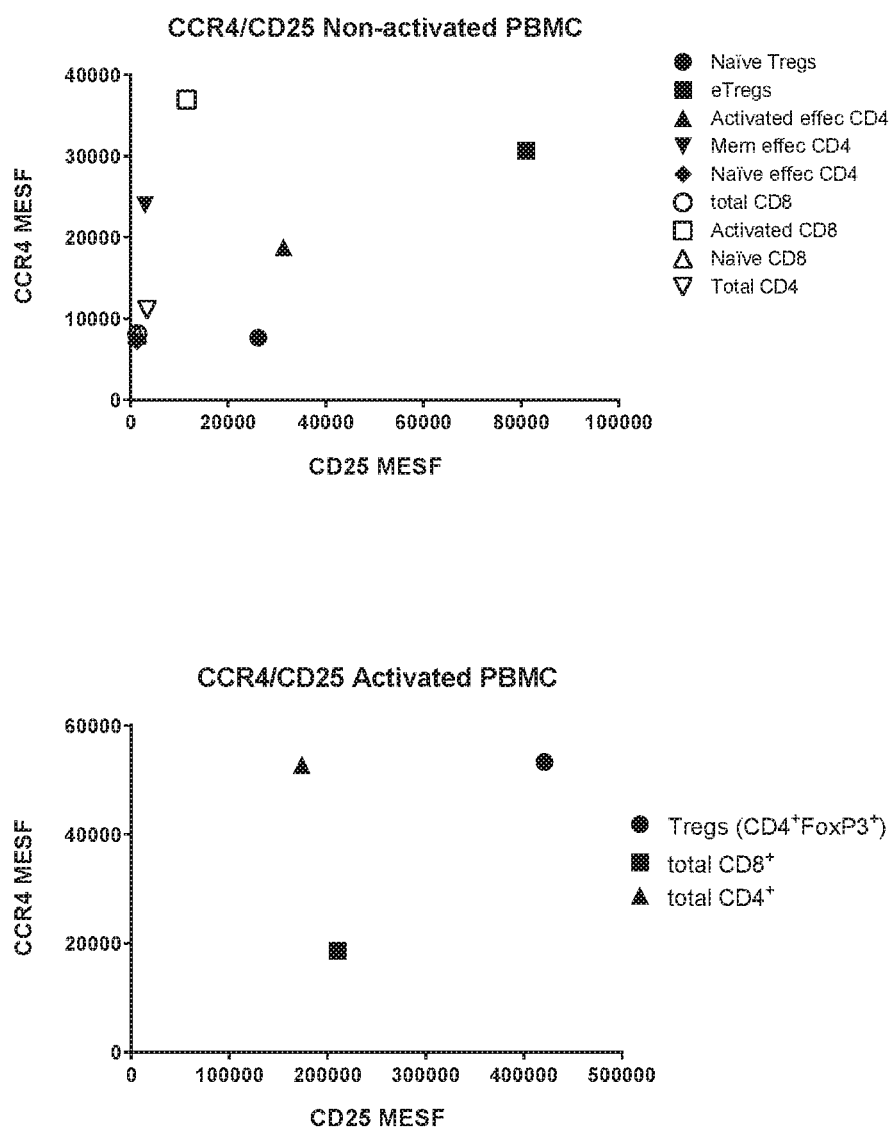
FIG. 55. MESF antigen density of CCR4 and CD25 on different populations of T cells in non-activated and activated PBMC.
Figure 56:
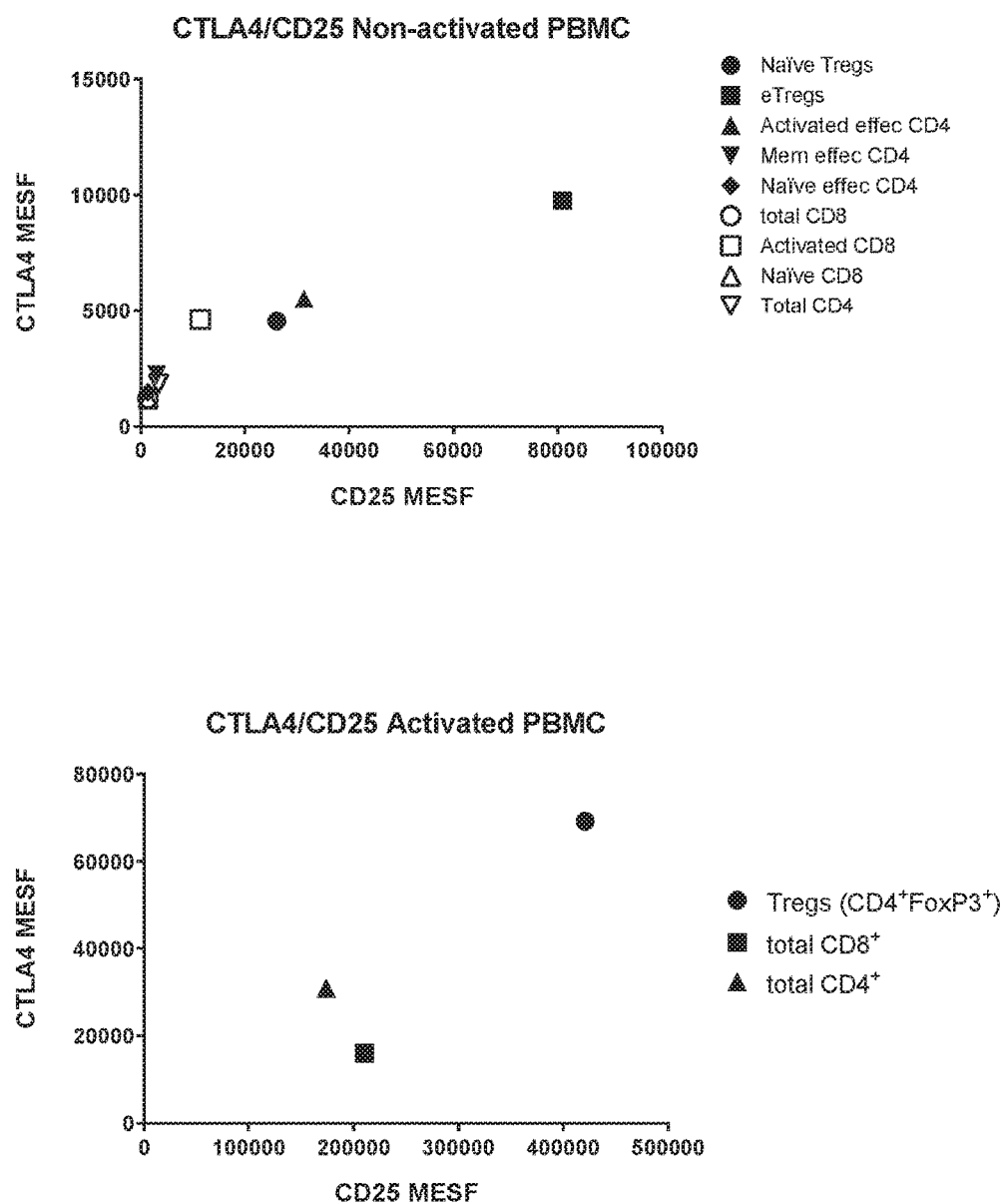
FIG. 56. MESF antigen density of CTLA4 and CD25 on different populations of T cells in non-activated and activated PBMC.
Figure 57:
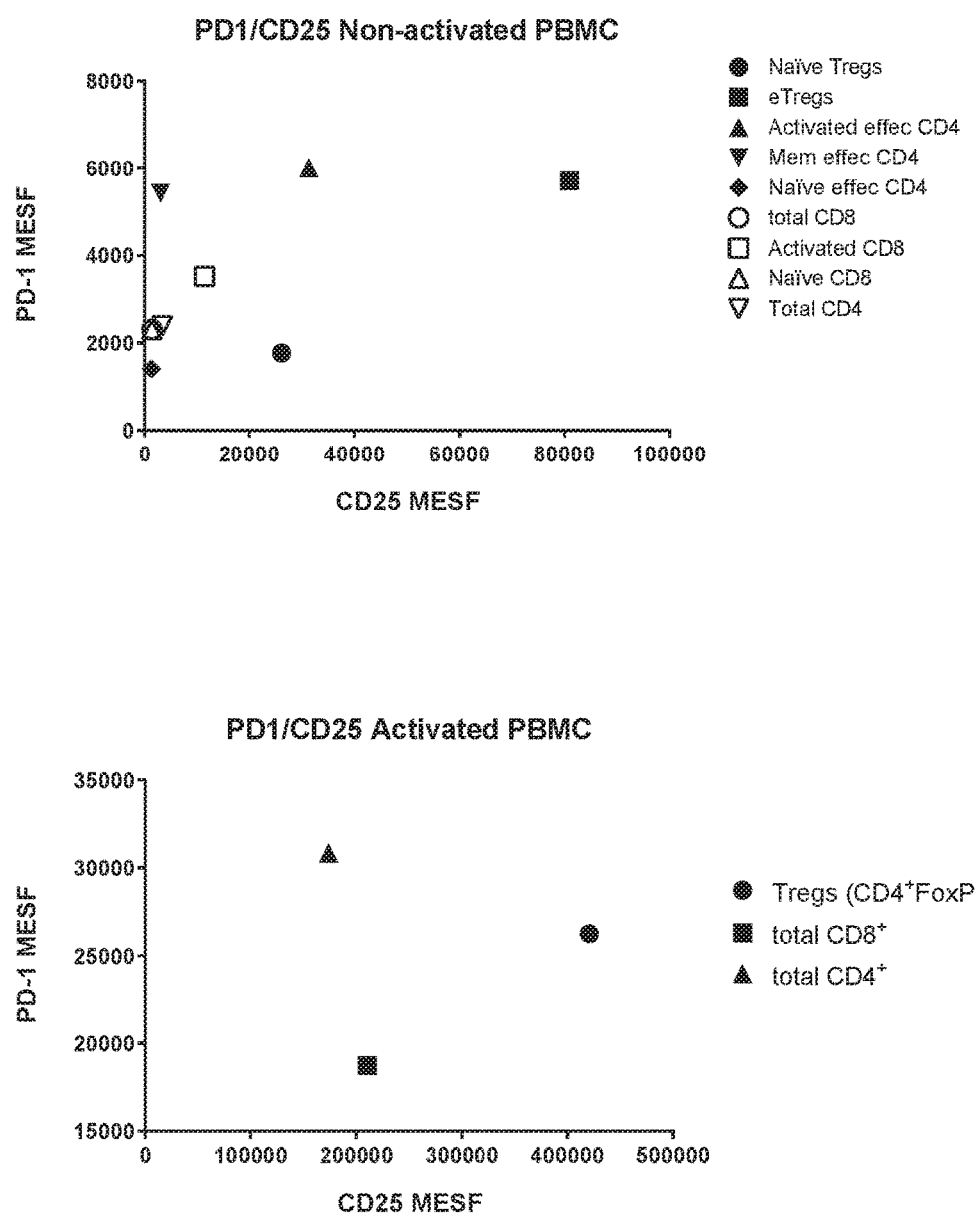
FIG. 57. MESF antigen density of PD1- and CD25 on different populations of T cells in non-activated and activated PBMC.

Cells were washed with FACs buffer and stained for CD3 (OKT3, PECγ7), CD4 (OKT4, APC/Cγ7), CD8 (RPA-T8, PerCPCγ5.5), CD45RA (HI100, FITC), CD25 (M-A251, BV421) and CCR4 (L291H4, APC) for 1 hr at 40° C. Cells were then washed with FACS buffer and fixed with FoxP3 fixation/permeabilization buffer (Ebioscience) overnight at 4° C. The following day, cells were stained with anti-FoxP3-PE (PCH1001) for 1 hr at 4° C. Cells were then analyzed on a FACS Canto 2. Cells were gated into populations of Naïve effector CD4+, Memory effector CD4+, activated effector CD4+, Naive Tregs, and activated Tregs based on the paper by Sugiyama et al (PNAS, 2013, 110(44) 17945-17950.) The gating strategy for unactivated PBMCs and activated PBMCs are shown in FIGS. 52 and 53, respectively. Cells were also evaluated for antigen density of CD4, CD25, CCR4, CTLA4, and PD-1 using MESF (FIGS. 54-58). In addition, antigen density of PBMCs activated with 0.2 ug/mL anti-CD3 for 3 days at 37 C was evaluated with MESF.

Cell count data were plotted with Graphpad Prism, and are shown in FIGS. 59-64. Data indicated effective depletion of effector Treg cells with all bispecific antibodies tested. Depletion was more selective towards Treg compared to other T-cell types with Anti-CCR4×CD25 and Anti-CTLA4×CD25 bispecifics, whereas anti-CD4×CD25 bispecifics demonstrated slightly more killing of non-Treg populations. MESF data indicated that the most favorable antigen profiles (high expression of target on effector Tregs, and low expression on other cell types) was for anti-CCR4×CD25, anti-CTLA4×CD25, and anti-CCR4×CTLA4.

Figure 59:
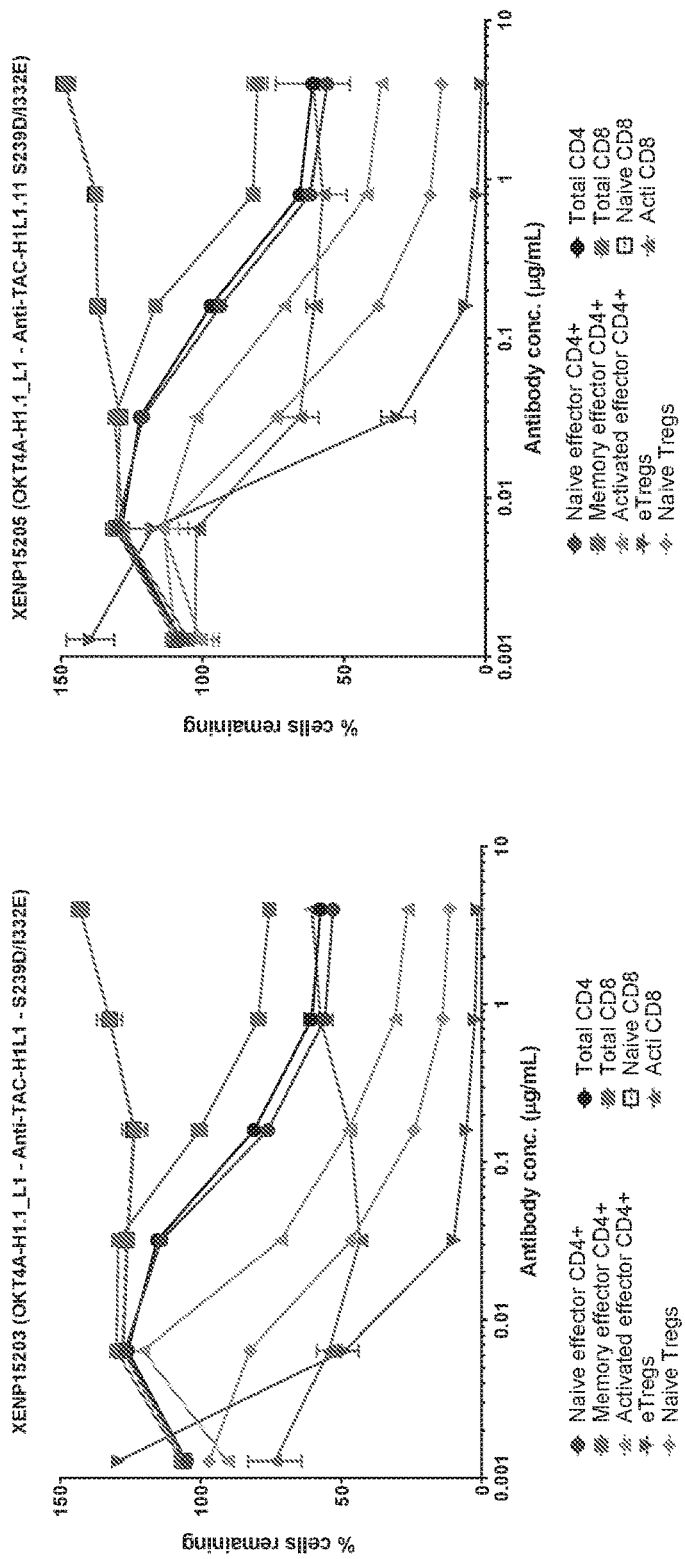
FIG. 59. Depletion of T cell populations in non-activated PBMC by Anti-CD4× Anti-CD25 (OKT4A H1.1_L1.1× Anti-TAC H1L1 and OKT4A H1.1_L1.1× Anti-TAC H1_L1.11) Treg depleting bispecific antibodies.
Figure 60:
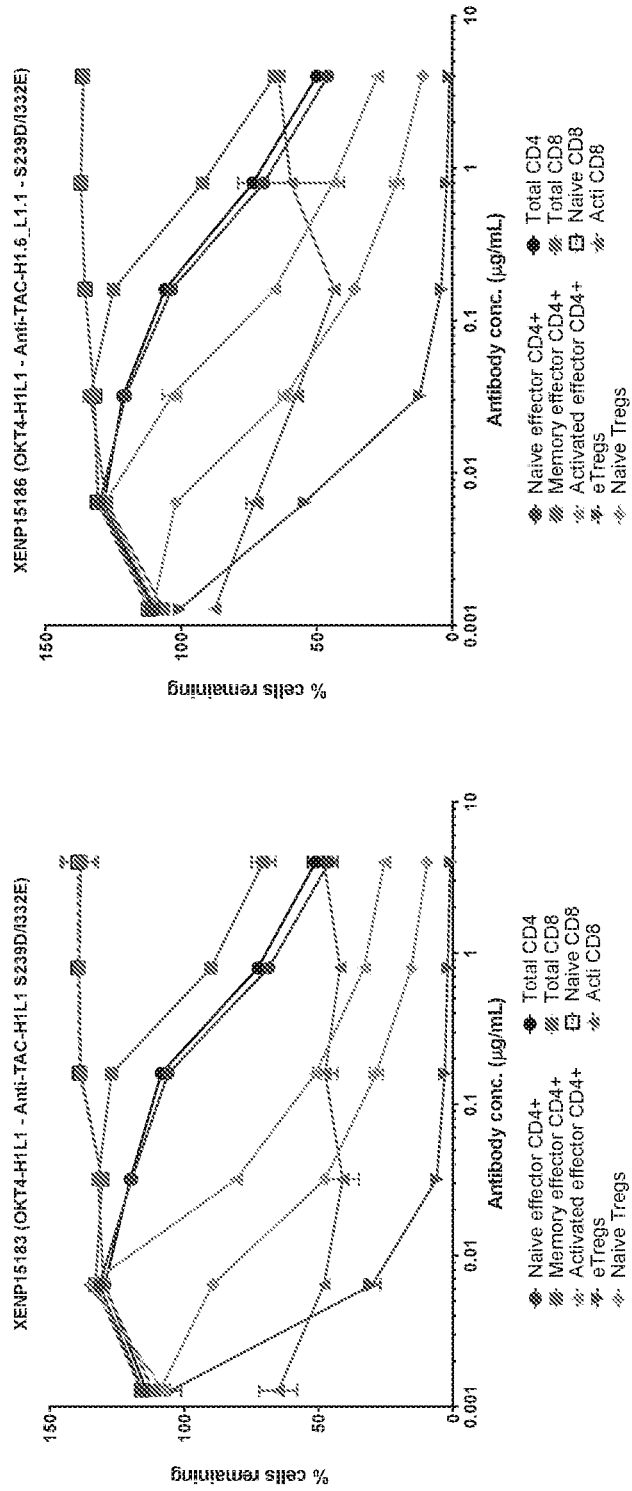
FIG. 60. Depletion of T cell populations in non-activated PBMC by Anti-CD4× Anti-CD25 (OKT4 H1L1× Anti-TAC H1L1 and OKT4 H1L1× Anti-TAC H1.6_L1.1) Treg depleting bispecific antibodies.

Example 15. Depletion of Regulatory T Cells in a Single-Dose Multi-Donor MLR Assay MLR reactions using 18 different PBMC donor pairs were setup by mixing 400,000 cells from each of two different donors along with 10 ug/mL of bispecific or control antibody. On day 6 supernatants were collected and the cells were stained for CD3 (OKT3, PECγ7), CD4 (OKT4, APC/Cγ7), CD8 (RPA-T8, PerCPCγ5.5), CD45RA (HI100, FITC), and CD25 (M-A251, BV421) for 1 h at 40° C. The cells were then washed with FACs buffer (2×) and fixed with Ebioscience FoxP3 fixation/permeabilization buffer (100 μl) over night at 40° C. The following day cells were stained for FoxP3 (PCH1001, PE) and Ki-67 (20Raj1, APC) for 1 h at 40° C. and cells were analyzed on a FACS Canto2. Cells counted were Tregs (CD4+CD25+FoxP3hi), eTregs (CD4+ CD45RA−), total CD8+, total CD4+, CD8+Ki67+, CD4+ Ki67+ and/or activated CD4 (CD4+CD25+). Data are shown in FIG. 59. Also plotted is CD8/Treg ratio. A higher CD8/Treg ratio is favorable for treatment of cancer. XENP15449 (Anti-TAC_H1_L1.11 IgG1 S239D/I332E) and 16791 (Anti-CCR4× Anti-CD25 IgG1 S239D/I332E) showed the highest CD8/Treg ratios out of those tested in this experiment. The same experiment was repeated with a different set of bispecifics and control antibodies, and the data is shown in FIG. 60. In this second experiment, XENP16791, 15836, 15205, and 15239 showed strong eTreg depletion.

Figure 61:
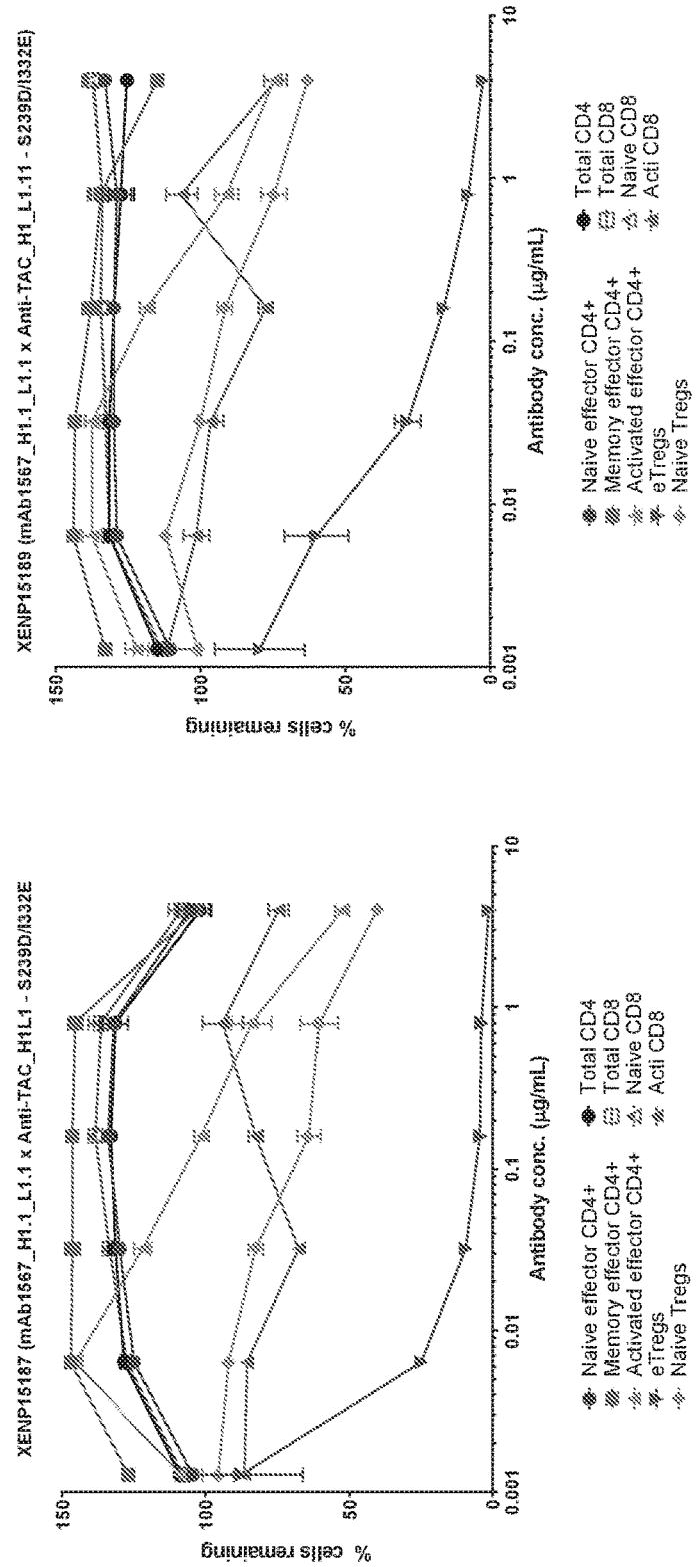
FIG. 61. Depletion of T cell populations in non-activated PBMC by Anti-CCR4× Anti-CD25 (mAb1567 H1.1_L1× Anti-TAC H1L1 and mAb1567 H1.1_L1× Anti-TAC H1_L1.11) Treg depleting bispecific antibodies.
Figure 62:
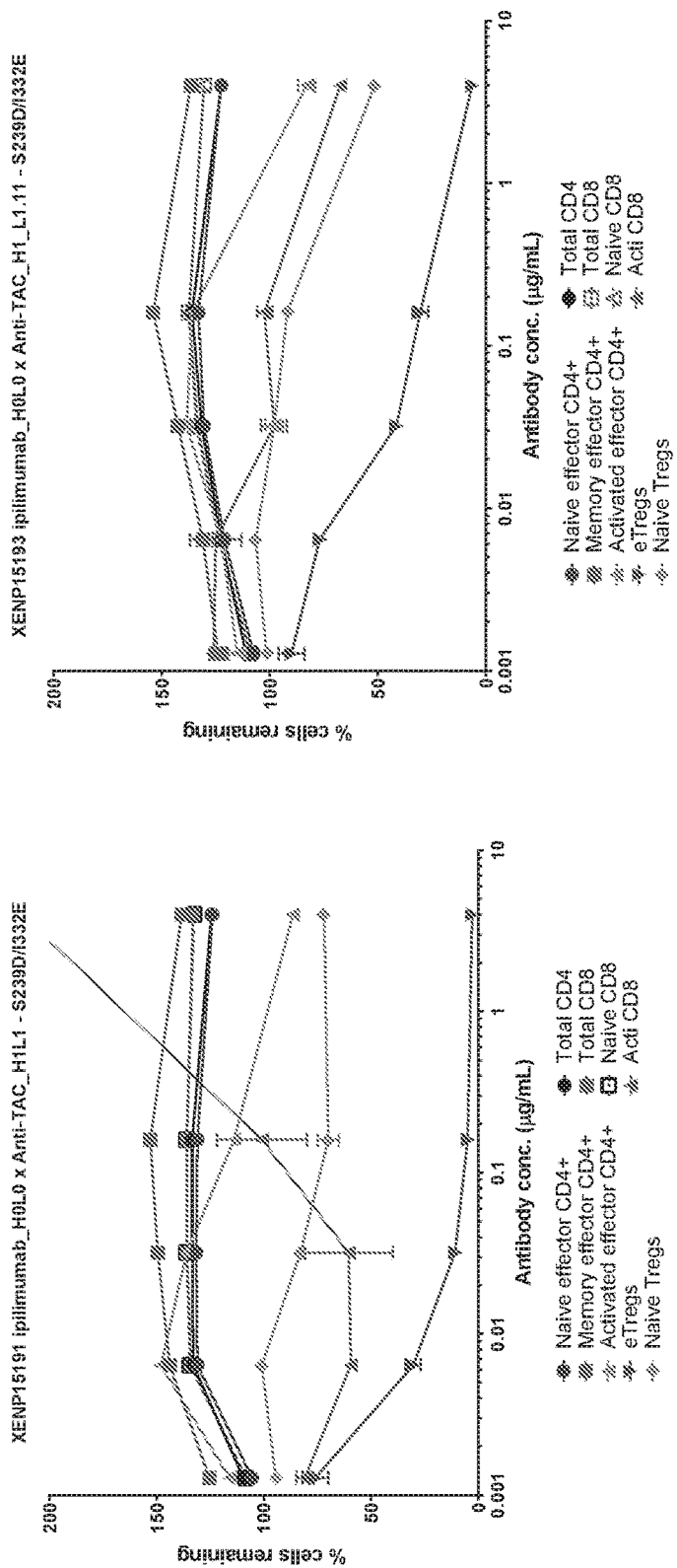
FIG. 62. Depletion of T cell populations in non-activated PBMC by Anti-CTLA4× Anti-CD25 (ipilimumab H0L0× Anti-TAC H1L1 and ipilimumab H0L0× Anti-TAC H1_L1.11) Treg depleting bispecific antibodies.
Figure 63:
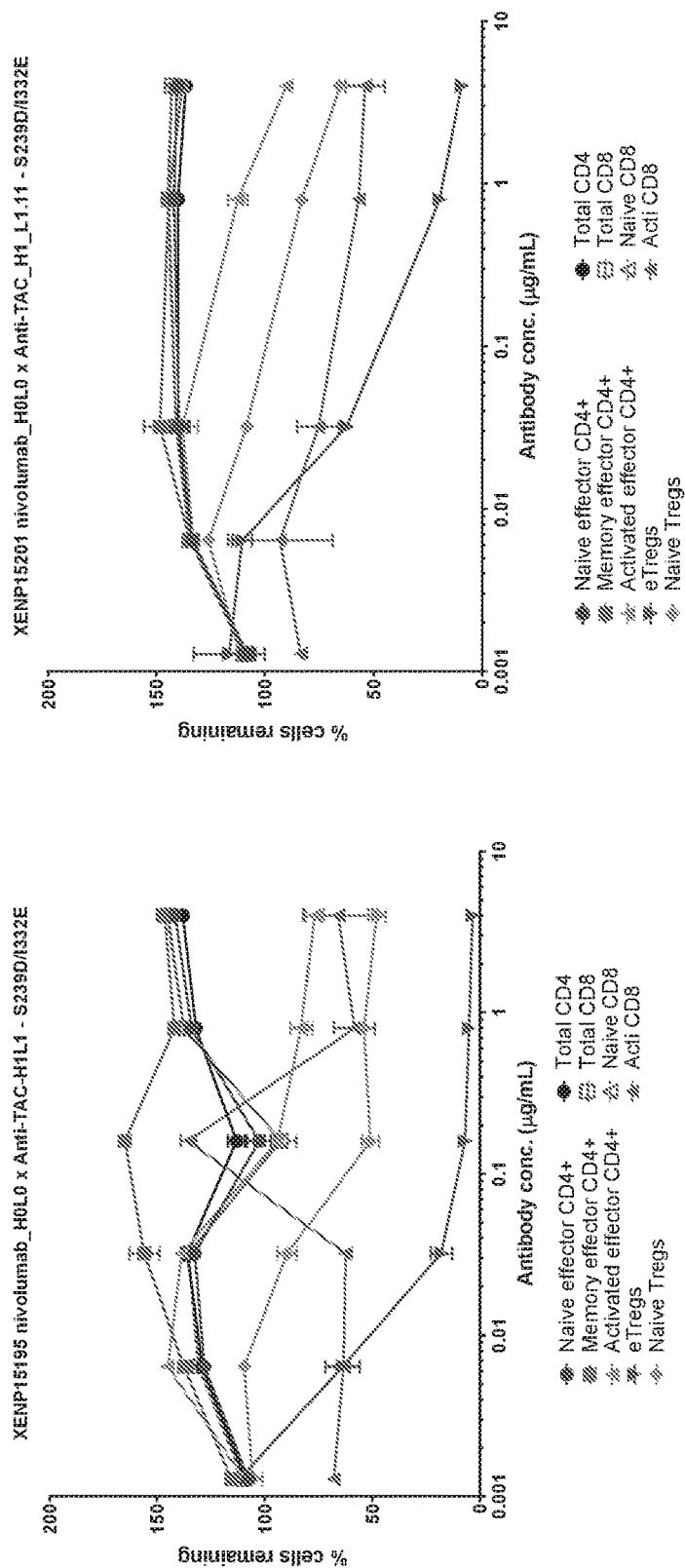
FIG. 63. Depletion of T cell populations in non-activated PBMC by Anti-PD-1× Anti-CD25 (nivolumab H0L0× Anti-TAC H1L1 and nivolumab H0L0× Anti-TAC H1_L1.11) Treg depleting bispecific antibodies.

Example 16. Depletion of Regulatory T Cells in a Multi-Dose Multi-Donor MLR Assay MLR reactions using 18 different PBMC donor pairs were setup by mixing 400,000 cells from each of two different donors along with bispecific or control antibody. Six concentrations were tested for each antibody from 10 ug/mL down to 0.001 ug/mL in 6-fold dilutions. On day 6 supernatants were collected and the cells were stained for CD3 (OKT3, PECγ7), CD4 (OKT4, APC/Cγ7), CD8 (RPA-T8, PerCPCγ5.5), CD45RA (HI100, FITC), and CD25 (M-A251, BV421) for 1 h at 40° C. The cells were then washed with FACs buffer (2×) and fixed with Ebioscience FoxP3 fixation/permeabilization buffer (100 μl) over night at 40° C. The following day cells were stained for FoxP3 (PCH1001, PE) and Ki-67 (20Raj1, APC) for 1 h at 40° C. and cells were analyzed on a FACS Canto2. Cells counted were Tregs (CD4+CD25+FoxP3hi), eTregs (CD4+ CD45RA−), total CD8+, total CD4+, CD8+Ki67+, CD4+ Ki67+ and/or activated CD4 (CD4+CD25+). Data are shown in FIG. 61. Bispecific antibodies XENP16791 (Anti-CCR4× Anti-CD25 IgG1 S239D/I332E) and XENP16667 (Anti-CTLA4× Anti-CCR4 IgG1 S239D/I332E) showed selective depletion of eTregs when compared to XENP6369 (daclizumab).

SEQUENCE LISTING (509 sequences)

SEQ ID NO: 1 - protein, 107 aa, Artificial Sequence [sequence omitted]

SEQ ID NO: 2 - protein, 330 aa, Artificial Sequence
  IgG1 constant heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - protein, 326 aa, Artificial Sequence
  IgG2 constant heavy chain
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 4 - protein, 377 aa, Artificial Sequence
  IgG3 constant heavy chain
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 5 - protein, 327 aa, Artificial Sequence
  IgG4 constant heavy chain
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 6 - protein, 329 aa, Artificial Sequence
  IgG1/2 constant heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 7 - protein, 450 aa, Artificial Sequence
  OKT4A_H0_IgG1
EVILVQSGGALVEPGGSLKLSCSASGFTFSNYAMSWVRQTPEKRLEWVAAISDHSTNTYYPDSVKGRFTISRDNAKNTLYLQMNSLRSEDTAIYYCARKYGGDYDPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8 - protein, 450 aa, Artificial Sequence
  OKT4A_H0_Hybrid_S239D/I332E
EVILVQSGGALVEPGGSLKLSCSASGFTFSNYAMSWVRQTPEKRLEWVAAISDHSTNTYYPDSVKGRFTISRDNAKNTLYLQMNSLRSEDTAIYYCARKYGGDYDPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKCKVSNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 9 - protein, 214 aa, Artificial Sequence
  OKT4A_L0
DIQMTQSPSSLSASLGGKVTIACKASQDINNYIAWYQHKPGKGPRLLIHYTSTLQPGIPSRFSGSGSGRDYSFSISNLEPEDIATYYCLQYDNLLFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10 - protein, 445 aa, Artificial Sequence
  HuMax-TAC_H0_IgG1
QVQLVQSGAEVKKPGSSVKVSCKASGGTFSRYIINWVRQAPGQGLEWMGRIIPILGVENYAQKFQGRVTITADKSTSTAYMELSSLRSEDTAVYYCARKDWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - protein, 214 aa, Artificial Sequence
  HuMax-TAC_L0
EIVLTQSPGTLSLSPGERATLSCRASQSVSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12 - protein, 446 aa, Artificial Sequence
  Anti-TAC_H1_IgG1
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - protein, 213 aa, Artificial Sequence
  Anti-TAC_L1
QIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14 - protein, 447 aa, Artificial Sequence
  Basiliximab_H0
QVQLQQSGTVLARPGASVKMSCKASGYSFTRYWMHWIKQRPGQGLEWIGAIYPGNSDTSYNQKFEGKAKLTAVTSASTAYMELSSLTHEDSAVYYCSRDYGYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15 - protein, 211 aa, Artificial Sequence
  Basiliximab_L0
QIVSTQSPAIMSASPGEKVTMTCSASSSRSYMQWYQQKPGTSPKRWIYDTSKLASGVPARFSGSGSGTSYSLTISSMEAEDAATYYCHQRSSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16 - protein, 452 aa, Artificial Sequence
  Ibalizumab_H0
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - protein, 219 aa, Artificial Sequence
  Ibalizumab_L0
DIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18 - protein, 445 aa, Artificial Sequence
  Zanolimumab_H0
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVINWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - protein, 214 aa, Artificial Sequence
  Zanolimumab_L0
DIQMTQSPSSVSASVGDRVTITCRASQDISSWLAWYQHKPGKAPKLLIYAASSLQSGVPSRFSGSGSGTDFTLTISSLQPEDFATYYCQQANSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20 - protein, 449 aa, Artificial Sequence
  Heavy chain 1
EVILVQSGGALVEPGGSLKLSCSASGFTFSNYAMSWVRQTPEKRLEWVAAISDHSTNTYYPDSVKGRFTISRDNAKNTLYLQMNSLRSEDTAIYYCARKYGGDYDPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 21 - protein, 445 aa, Artificial Sequence
  Heavy chain 2
QVQLVQSGAEVKKPGSSVKVSCKASGGTFSRYIINWVRQAPGQGLEWMGRIIPILGVENYAQKFQGRVTITADKSTSTAYMELSSLRSEDTAVYYCARKDWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 214 aa, Artificial Sequence; identical to SEQ ID NO: 9
  Light chain

SEQ ID NO: 23 - protein, 449 aa, Artificial Sequence
  Heavy chain 1
EVILVQSGGALVEPGGSLKLSCSASGFTFSNYAMSWVRQTPEKRLEWVAAISDHSTNTYYPDSVKGRFTISRDNAKNTLYLQMNSLRSEDTAIYYCARKYGGDYDPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPDVFLFPPKPKDTLMISRTPEVTCVVVDVSHEDPEVQFNWYVDGVEVHNAKTKPREEQYNSTYRVVSVLTVLHQDWLNGKEYKCKVSNKALPAPEEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 24 - protein, 445 aa, Artificial Sequence
  Heavy chain 2
QVQLVQSGAEVKKPGSSVKVSCKASGGTFSRYIINWVRQAPGQGLEWMGRIIPILGVENYAQKFQGRVTITADKSTSTAYMELSSLRSEDTAVYYCARKDWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLGGPDVFLFPPKPKDTLMISRTPEVTCVVVDVSHEDPEVKFKWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - protein, 214 aa, Artificial Sequence; identical to SEQ ID NO: 9
  Light chain

SEQ ID NO: 26 - protein, 481 aa, Artificial Sequence
  Heavy chain 1
EVILVQSGGALVEPGGSLKLSCSASGFTFSNYAMSWVRQTPEKRLEWVAAISDHSTNTYYPDSVKGRFTISRDNAKNTLYLQMNSLRSEDTAIYYCARKYGGDYDPFDYWGQGTTLTVSSGGGGSGGGGSGGGGSGGGGSDIQMTQSPSSLSASLGGKVTIACKASQDINNYIAWYQHKPGKGPRLLIHYTSTLQPGIPSRFSGSGSGRDYSFSISNLEPEDIATYYCLQYDNLLFTFGGGTKLEIKGDQEPKSSDKTHTCPPCPAPELLGGPDVFLFPPKPKDTLMISRTPEVTCVVVDVSHEDPEVQFNWYVDGVEVHNAKTKPREEQYNSTYRVVSVLTVLHQDWLNGKEYKCKVSNKALPAPEEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 27 - protein, 477 aa, Artificial Sequence
  Heavy chain 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGGGGSGGGGSGGGGSGGGGSQIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKGDQERKSSDKTHTCPRCPAPELLGGPDVFLFPPKPKDTLMISRTPEVTCVVVDVSHEDPEVKFKWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 214 aa, Artificial Sequence; identical to SEQ ID NO: 9
  Light chain

SEQ ID NO: 29 - protein, 478 aa, Artificial Sequence
  Heavy chain 1
EVILVQSGGALVEPGGSLKLSCSASGFTFSNYAMSWVRQTPEKRLEWVAAISDHSTNTYYPDSVKGRFTISRDNAKNTLYLQMNSLRSEDTAIYYCARKYGGDYDPFDYWGQGTTLTVSSGGGGSGGGGSGGGGSGGGGSDIQMTQSPSSLSASLGGKVTIACKASQDINNYIAWYQHKPGKGPRLLIHYTSTLQPGIPSRFSGSGSGRDYSFSISNLEPEDIATYYCLQYDNLLFTFGGGTKLEIKEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 30 - protein, 474 aa, Artificial Sequence
  Heavy chain 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGGGGSGGGGSGGGGSGGGGSQIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 481 aa, Artificial Sequence
  Heavy chain 1
EVILVQSGGALVEPGGSLKLSCSASGFTFSNYAMSWVRQTPEKRLEWVAAISDHSTNTYYPDSVKGRFTISRDNAKNTLYLQMNSLRSEDTAIYYCARKYGGDYDPFDYWGQGTTLTVSSGGGGSGGGGSGGGGSGGGGSDIQMTQSPSSLSASLGGKVTIACKASQDINNYIAWYQHKPGKGPRLLIHYTSTLQPGIPSRFSGSGSGRDYSFSISNLEPEDIATYYCLQYDNLLFTFGGGTKLEIKGDQEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 32 - protein, 477 aa, Artificial Sequence
  Heavy chain 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGGGGSGGGGSGGGGSGGGGSQIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKGDQERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - protein, 449 aa, Artificial Sequence
  Heavy chain 1
EVILVQSGGALVEPGGSLKLSCSASGFTFSNYAMSWVRQTPEKRLEWVAAISDHSTNTYYPDSVKGRFTISRDNAKNTLYLQMNSLRSEDTAIYYCARKYGGDYDPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 34 - protein, 445 aa, Artificial Sequence
  Heavy chain 2
QVQLVQSGAEVKKPGSSVKVSCKASGGTFSRYIINWVRQAPGQGLEWMGRIIPILGVENYAQKFQGRVTITADKSTSTAYMELSSLRSEDTAVYYCARKDWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 214 aa, Artificial Sequence; identical to SEQ ID NO: 9
  Light chain

SEQ ID NO: 36 - protein, 364 aa, Artificial Sequence
  Heavy chain 1
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 37 - protein, 450 aa, Artificial Sequence
  Heavy chain 2
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 214 aa, Artificial Sequence
  Light chain
DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 39 - protein, 364 aa, Artificial Sequence; identical to SEQ ID NO: 36
  Heavy chain

SEQ ID NO: 40 - protein, 364 aa, Artificial Sequence; identical to SEQ ID NO: 36
  Heavy chain 1

SEQ ID NO: 41 - protein, 232 aa, Artificial Sequence
  Heavy chain 2
EPKSSDKTHTCPPCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 593 aa, Artificial Sequence
  Heavy chain
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLRGPSVFLFPPKPKDTLMISRTPEVTCVVVDVSHEDPEVKFNWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 43 - protein, 214 aa, Artificial Sequence; identical to SEQ ID NO: 38
  Light chain

SEQ ID NO: 44 - protein, 446 aa, Artificial Sequence; identical to SEQ ID NO: 12
  Heavy chain

SEQ ID NO: 45 - protein, 213 aa, Artificial Sequence; identical to SEQ ID NO: 13
  Light chain

SEQ ID NO: 46 - protein, 446 aa, Artificial Sequence
  Heavy chain
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 213 aa, Artificial Sequence
  Light chain
DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - protein, 450 aa, Artificial Sequence; identical to SEQ ID NO: 7
  Heavy chain

SEQ ID NO: 49 - protein, 214 aa, Artificial Sequence; identical to SEQ ID NO: 9
  Light chain

SEQ ID NO: 50 - protein, 450 aa, Artificial Sequence
  Heavy chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - protein, 213 aa, Artificial Sequence
  Light chain
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 449 aa, Artificial Sequence
  Heavy chain 1
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 53 - protein, 474 aa, Artificial Sequence; identical to SEQ ID NO: 30
  Heavy chain 2

SEQ ID NO: 54 - protein, 214 aa, Artificial Sequence; identical to SEQ ID NO: 38
  Light chain

SEQ ID NO: 55 - protein, 450 aa, Artificial Sequence
  Heavy chain (
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 214 aa, Artificial Sequence; identical to SEQ ID NO: 38
  Light chain

SEQ ID NO: 57 - protein, 450 aa, Artificial Sequence
  Heavy chain
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLRGPSVFLFPPKPKDTLMISRTPEVTCVVVDVSHEDPEVKFNWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 214 aa, Artificial Sequence; identical to SEQ ID NO: 38
  Light chain

SEQ ID NO: 59 - protein, 449 aa, Artificial Sequence
  Heavy chain 1
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 60 - protein, 232 aa, Artificial Sequence
  Heavy chain 2
ERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 214 aa, Artificial Sequence; identical to SEQ ID NO: 38
  Light chain

SEQ ID NO: 62 - protein, 231 aa, Artificial Sequence
  Heavy chain 1
EPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 63 - protein, 474 aa, Artificial Sequence
  Heavy chain 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGGGGSGGGGSGGGGSGGGGSQIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKERKSSDKTHTCPRCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 478 aa, Artificial Sequence
  Heavy chain 1
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSGGGGSGGGGSGGGGSGGGGSDIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIKEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 65 - protein, 474 aa, Artificial Sequence; identical to SEQ ID NO: 30
  Heavy chain 2

SEQ ID NO: 66 - protein, 231 aa, Artificial Sequence
  Heavy chain 1
EPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 67 - protein, 474 aa, Artificial Sequence; identical to SEQ ID NO: 30
  Heavy chain 2

SEQ ID NO: 68 - protein, 451 aa, Artificial Sequence
  Heavy chain 1
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 69 - protein, 474 aa, Artificial Sequence; identical to SEQ ID NO: 30
  Heavy chain 2

SEQ ID NO: 70 - protein, 219 aa, Artificial Sequence; identical to SEQ ID NO: 17
  Light chain

SEQ ID NO: 71 - protein, 451 aa, Artificial Sequence; identical to SEQ ID NO: 68
  Heavy chain 1

SEQ ID NO: 72 - protein, 232 aa, Artificial Sequence
  Heavy chain 2
ERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 219 aa, Artificial Sequence; identical to SEQ ID NO: 17
  Light chain

SEQ ID NO: 74 - protein, 449 aa, Artificial Sequence; identical to SEQ ID NO: 52
  Heavy chain 1

SEQ ID NO: 75 - protein, 474 aa, Artificial Sequence
  Heavy chain 2
QVQLVQSGAEVKKPGASVKVSCKASGYTFTSYRMHWVRQAPGQGLEWMGWINPSTGYTEYNQKFQGRVTITADKSISTAYMELSRLRSDDTAVYYCARGGGVFDYWGQGTLVTVSSGGGGSGGGGSGGGGSGGGGSQIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 214 aa, Artificial Sequence; identical to SEQ ID NO: 38
  Light chain

SEQ ID NO: 77 - protein, 449 aa, Artificial Sequence; identical to SEQ ID NO: 52
  Heavy chain 1

SEQ ID NO: 78 - protein, 474 aa, Artificial Sequence
  Heavy chain 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGGGGSGGGGSGGGGSGGGGSQIVLTQSPATLSLSPGERATLSCRASSSISYMHWFQQKPGQSPQLLIYTASNLASGVPARFSGSGSGTDYTLTISSLQPEDFAVYYCHQRSTYPLTFGSGTKLEIKERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 214 aa, Artificial Sequence; identical to SEQ ID NO: 38
  Light chain

SEQ ID NO: 80 - protein, 449 aa, Artificial Sequence; identical to SEQ ID NO: 52
  Heavy chain 1

SEQ ID NO: 81 - protein, 232 aa, Artificial Sequence; identical to SEQ ID NO: 72
  Heavy chain 2

SEQ ID NO: 82 - protein, 214 aa, Artificial Sequence; identical to SEQ ID NO: 38
  Light chain

SEQ ID NO: 83 - protein, 231 aa, Artificial Sequence; identical to SEQ ID NO: 66
  Heavy chain 1

SEQ ID NO: 84 - protein, 474 aa, Artificial Sequence; identical to SEQ ID NO: 78
  Heavy chain 2

SEQ ID NO: 85 - protein, 231 aa, Artificial Sequence; identical to SEQ ID NO: 66
  Heavy chain 1

SEQ ID NO: 86 - protein, 474 aa, Artificial Sequence; identical to SEQ ID NO: 75
  Heavy chain 2

SEQ ID NO: 87 - protein, 364 aa, Artificial Sequence
  Heavy chain 1
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 451 aa, Artificial Sequence
  Heavy chain 2
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 89 - protein, 219 aa, Artificial Sequence; identical to SEQ ID NO: 17
  Light chain

SEQ ID NO: 90 - protein, 364 aa, Artificial Sequence; identical to SEQ ID NO: 87
  Heavy chain 1

SEQ ID NO: 91 - protein, 449 aa, Artificial Sequence
  Heavy chain 2
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 92 - protein, 214 aa, Artificial Sequence; identical to SEQ ID NO: 38
  Light chain

SEQ ID NO: 93 - protein, 449 aa, Artificial Sequence; identical to SEQ ID NO: 91
  Heavy chain 1

SEQ ID NO: 94 - protein, 473 aa, Artificial Sequence
  Heavy chain 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGGGGSGGGGSGGGGSGGGGSQIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 214 aa, Artificial Sequence; identical to SEQ ID NO: 38
  Light chain

SEQ ID NO: 96 - protein, 451 aa, Artificial Sequence; identical to SEQ ID NO: 88
  Heavy chain 1

SEQ ID NO: 97 - protein, 473 aa, Artificial Sequence; identical to SEQ ID NO: 94
  Heavy chain 2

SEQ ID NO: 98 - protein, 219 aa, Artificial Sequence; identical to SEQ ID NO: 17
  Light chain

SEQ ID NO: 99 - protein, 364 aa, Artificial Sequence; identical to SEQ ID NO: 36
  Heavy chain 1

SEQ ID NO: 100 - protein, 450 aa, Artificial Sequence; identical to SEQ ID NO: 37
  Heavy chain 2

SEQ ID NO: 101 - protein, 214 aa, Artificial Sequence; identical to SEQ ID NO: 38
  Light chain

SEQ ID NO: 102 - protein, 343 aa, Artificial Sequence
  Heavy chain 1
APASSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 103 - protein, 450 aa, Artificial Sequence; identical to SEQ ID NO: 37
  Heavy chain 2

SEQ ID NO: 104 - protein, 214 aa, Artificial Sequence; identical to SEQ ID NO: 38
  Light chain

SEQ ID NO: 105 - protein, 343 aa, Artificial Sequence
  Heavy chain 1
APASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLTGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 106 - protein, 450 aa, Artificial Sequence; identical to SEQ ID NO: 37
  Heavy chain 2

SEQ ID NO: 107 - protein, 214 aa, Artificial Sequence; identical to SEQ ID NO: 38
  Light chain

SEQ ID NO: 108 - protein, 343 aa, Artificial Sequence
  Heavy chain 1
APTSSSTKKTQLQLEHLLLDLQMILNGISNHKNPRLARMLTFKFYMPEKATELKHLQCLEEELKPLEEALRLAPSKNFHLRPRDLISDVNVIVLELKGSETTFMCEYADETATIVEFLNRWITFSQSIISTLTGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 109 - protein, 450 aa, Artificial Sequence; identical to SEQ ID NO: 37
  Heavy chain 2

SEQ ID NO: 110 - protein, 214 aa, Artificial Sequence; identical to SEQ ID NO: 38
  Light chain

SEQ ID NO: 111 - protein, 343 aa, Artificial Sequence
  Heavy chain 1
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSTISTLTGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 112 - protein, 450 aa, Artificial Sequence; identical to SEQ ID NO: 37
  Heavy chain 2

SEQ ID NO: 113 - protein, 214 aa, Artificial Sequence; identical to SEQ ID NO: 38
  Light chain

SEQ ID NO: 114 - protein, 343 aa, Artificial Sequence
  Heavy chain 1
APTSSSTKKTQLQLEHLLLDLQMILNGISNHKNPRLARMLTFKFYMPEKATELKHLQCLEEELKPLEEALRLAPSKNFHLRPRDLISDVNVIVLELKGSETTFMCEYADETATIVEFLNRWITFSTSIISTLTGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 115 - protein, 450 aa, Artificial Sequence; identical to SEQ ID NO: 37
  Heavy chain 2

SEQ ID NO: 116 - protein, 214 aa, Artificial Sequence; identical to SEQ ID NO: 38
  Light chain

SEQ ID NO: 117 - protein, 343 aa, Artificial Sequence
  Heavy chain 1
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSTSIISTLTGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 118 - protein, 450 aa, Artificial Sequence; identical to SEQ ID NO: 37
  Heavy chain 2

SEQ ID NO: 119 - protein, 214 aa, Artificial Sequence; identical to SEQ ID NO: 38
  Light chain

SEQ ID NO: 120 - protein, 343 aa, Artificial Sequence
  Heavy chain 1
APTSSSTKKTQLQLEHLLLDLQMILNGINNYKNPKLTRMLTFKFYMPKKATELKHLQCLEEELKPLEEVLNLAQSKNFHLRPRDLISRINVIVLELKGSETTFMCEYADETATIVEFLNRWITFSQSIISTLTGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 121 - protein, 450 aa, Artificial Sequence; identical to SEQ ID NO: 37
  Heavy chain 2

SEQ ID NO: 122 - protein, 214 aa, Artificial Sequence; identical to SEQ ID NO: 38
  Light chain

SEQ ID NO: 123 - protein, 448 aa, Artificial Sequence
  Heavy chain
QVQLQQSGPELVRPGASVRISCKASGYTFASYYIQWMKQRPGQGLEWIGWINPGNVNTKYNEKFKGKATLTADKSSTTAYMQLSSLTSEDSAVYFCARSTYYRPLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 219 aa, Artificial Sequence
  Light chain
DIELTQSPSSLAVSAGEKVTMSCKSSQSILYSSNQKNYLAWYQQKPGQSPKLLIYWASTRESGVPDRFTGSGSGTDFTLTISSVQAEDLAVYYCHQYLSSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 125 - protein, 448 aa, Artificial Sequence
  Heavy chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 215 aa, Artificial Sequence
  Light chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - protein, 364 aa, Artificial Sequence; identical to SEQ ID NO: 87
  Heavy chain 1

SEQ ID NO: 128 - protein, 449 aa, Artificial Sequence; identical to SEQ ID NO: 91
  Heavy chain 2

SEQ ID NO: 129 - protein, 214 aa, Artificial Sequence; identical to SEQ ID NO: 38
  Light chain

SEQ ID NO: 130 - protein, 364 aa, Artificial Sequence; identical to SEQ ID NO: 87
  Heavy chain 1

SEQ ID NO: 131 - protein, 451 aa, Artificial Sequence; identical to SEQ ID NO: 88
  Heavy chain 2

SEQ ID NO: 132 - protein, 219 aa, Artificial Sequence; identical to SEQ ID NO: 17
  Light chain

SEQ ID NO: 133 - protein, 449 aa, Artificial Sequence; identical to SEQ ID NO: 91
  Heavy chain 1

SEQ ID NO: 134 - protein, 473 aa, Artificial Sequence
  Heavy chain 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGKPGSGKPGSGKPGSGKPGSQIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - protein, 214 aa, Artificial Sequence; identical to SEQ ID NO: 38
  Light chain

SEQ ID NO: 136 - protein, 451 aa, Artificial Sequence; identical to SEQ ID NO: 88
  Heavy chain 1

SEQ ID NO: 137 - protein, 473 aa, Artificial Sequence; identical to SEQ ID NO: 134
  Heavy chain 2

SEQ ID NO: 138 - protein, 219 aa, Artificial Sequence; identical to SEQ ID NO: 17
  Light chain

SEQ ID NO: 139 - protein, 231 aa, Artificial Sequence
  Heavy chain 1
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 140 - protein, 473 aa, Artificial Sequence; identical to SEQ ID NO: 134
  Heavy chain 2

SEQ ID NO: 141 - protein, 364 aa, Artificial Sequence; identical to SEQ ID NO: 87
  Heavy chain 1

SEQ ID NO: 142 - protein, 231 aa, Artificial Sequence; identical to SEQ ID NO: 139
  Heavy chain 2

SEQ ID NO: 143 - protein, 451 aa, Artificial Sequence; identical to SEQ ID NO: 88
  Heavy chain 1

SEQ ID NO: 144 - protein, 231 aa, Artificial Sequence
  Heavy chain 2
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 145 - protein, 219 aa, Artificial Sequence; identical to SEQ ID NO: 17
  Light chain

SEQ ID NO: 146 - protein, 449 aa, Artificial Sequence; identical to SEQ ID NO: 91
  Heavy chain 1

SEQ ID NO: 147 - protein, 231 aa, Artificial Sequence; identical to SEQ ID NO: 144
  Heavy chain 2

SEQ ID NO: 148 - protein, 214 aa, Artificial Sequence; identical to SEQ ID NO: 38
  Light chain

SEQ ID NO: 149 - protein, 447 aa, Artificial Sequence
  Heavy chain 1
QVQLQQSGPELVRPGASVRISCKASGYTFASYYIQWMKQRPGQGLEWIGWINPGNVNTKYNEKFKGKATLTADKSSTTAYMQLSSLTSEDSAVYFCARSTYYRPLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 150 - protein, 473 aa, Artificial Sequence; identical to SEQ ID NO: 134
  Heavy chain 2

SEQ ID NO: 151 - protein, 219 aa, Artificial Sequence; identical to SEQ ID NO: 124
  Light chain

SEQ ID NO: 152 - protein, 447 aa, Artificial Sequence
  Heavy chain 1
QVQLQQSGPELVRPGASVRISCKASGYTFASYYIQWMKQRPGQGLEWIGWINPGNVNTKYNEKFKGKATLTADKSSTTAYMQLSSLTSEDSAVYFCARSTYYRPLDYWGQGTTVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - protein, 231 aa, Artificial Sequence; identical to SEQ ID NO: 139
  Heavy chain 2

SEQ ID NO: 154 - protein, 219 aa, Artificial Sequence; identical to SEQ ID NO: 124
  Light chain

SEQ ID NO: 155 - protein, 447 aa, Artificial Sequence
  Heavy chain 1
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 156 - protein, 473 aa, Artificial Sequence; identical to SEQ ID NO: 134
  Heavy chain 2

SEQ ID NO: 157 - protein, 215 aa, Artificial Sequence; identical to SEQ ID NO: 126
  Light chain

SEQ ID NO: 158 - protein, 447 aa, Artificial Sequence; identical to SEQ ID NO: 155
  Heavy chain 1

SEQ ID NO: 159 - protein, 231 aa, Artificial Sequence; identical to SEQ ID NO: 144
  Heavy chain 2

SEQ ID NO: 160 - protein, 215 aa, Artificial Sequence; identical to SEQ ID NO: 126
  Light chain

SEQ ID NO: 161 - protein, 447 aa, Artificial Sequence
  Heavy chain 1
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 231 aa, Artificial Sequence; identical to SEQ ID NO: 139
  Heavy chain 2

SEQ ID NO: 163 - protein, 215 aa, Artificial Sequence; identical to SEQ ID NO: 126
  Light chain

SEQ ID NO: 164 - protein, 375 aa, Artificial Sequence
  Heavy chain 1
EPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPGKGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 165 - protein, 450 aa, Artificial Sequence; identical to SEQ ID NO: 37
  Heavy chain 2

SEQ ID NO: 166 - protein, 214 aa, Artificial Sequence; identical to SEQ ID NO: 38
  Light chain

SEQ ID NO: 167 - protein, 508 aa, Artificial Sequence
  Heavy chain 1
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPGKGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 168 - protein, 450 aa, Artificial Sequence; identical to SEQ ID NO: 37
  Heavy chain 2

SEQ ID NO: 169 - protein, 214 aa, Artificial Sequence; identical to SEQ ID NO: 38
  Light chain

SEQ ID NO: 170 - protein, 593 aa, Artificial Sequence
  Heavy chain 1
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPGKGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 171 - protein, 450 aa, Artificial Sequence; identical to SEQ ID NO: 37
  Heavy chain 2

SEQ ID NO: 172 - protein, 214 aa, Artificial Sequence; identical to SEQ ID NO: 38
  Light chain

SEQ ID NO: 173 - protein, 375 aa, Artificial Sequence; identical to SEQ ID NO: 164
  Heavy chain 1

SEQ ID NO: 174 - protein, 593 aa, Artificial Sequence; identical to SEQ ID NO: 42
  Heavy chain 2

SEQ ID NO: 175 - protein, 214 aa, Artificial Sequence; identical to SEQ ID NO: 38
  Light chain

SEQ ID NO: 176 - protein, 375 aa, Artificial Sequence; identical to SEQ ID NO: 164
  Heavy chain 1

SEQ ID NO: 177 - protein, 593 aa, Artificial Sequence
  Heavy chain 2
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 178 - protein, 214 aa, Artificial Sequence; identical to SEQ ID NO: 38
  Light chain

SEQ ID NO: 179 - protein, 485 aa, Artificial Sequence
  Heavy chain 1
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSGGGGSGGGGSGGGGSGGGGSDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKEPKSSDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 180 - protein, 474 aa, Artificial Sequence; identical to SEQ ID NO: 63
  Heavy chain 2

SEQ ID NO: 181 - protein, 485 aa, Artificial Sequence
  Heavy chain 1
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSGGGGSGGGGSGGGGSGGGGSDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKEPKSSDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 182 - protein, 474 aa, Artificial Sequence; identical to SEQ ID NO: 30
  Heavy chain 2

SEQ ID NO: 183 - protein, 451 aa, Artificial Sequence
  Heavy chain 1
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 184 - protein, 474 aa, Artificial Sequence; identical to SEQ ID NO: 63
  Heavy chain 2

SEQ ID NO: 185 - protein, 219 aa, Artificial Sequence; identical to SEQ ID NO: 17
  Light chain

SEQ ID NO: 186 - protein, 343 aa, Artificial Sequence; identical to SEQ ID NO: 105
  Heavy chain 1

SEQ ID NO: 187 - protein, 232 aa, Artificial Sequence; identical to SEQ ID NO: 41
  Heavy chain 2

SEQ ID NO: 188 - protein, 343 aa, Artificial Sequence; identical to SEQ ID NO: 102
  Heavy chain 1

SEQ ID NO: 189 - protein, 232 aa, Artificial Sequence; identical to SEQ ID NO: 41
  Heavy chain 2

SEQ ID NO: 190 - protein, 343 aa, Artificial Sequence; identical to SEQ ID NO: 105
  Heavy chain 1

SEQ ID NO: 191 - protein, 232 aa, Artificial Sequence; identical to SEQ ID NO: 41
  Heavy chain 2

SEQ ID NO: 192 - protein, 343 aa, Artificial Sequence; identical to SEQ ID NO: 108
  Heavy chain 1

SEQ ID NO: 193 - protein, 232 aa, Artificial Sequence; identical to SEQ ID NO: 41
  Heavy chain 2

SEQ ID NO: 194 - protein, 343 aa, Artificial Sequence; identical to SEQ ID NO: 111
  Heavy chain 1

SEQ ID NO: 195 - protein, 232 aa, Artificial Sequence; identical to SEQ ID NO: 41
  Heavy chain 2

SEQ ID NO: 196 - protein, 343 aa, Artificial Sequence; identical to SEQ ID NO: 114
  Heavy chain 1

SEQ ID NO: 197 - protein, 232 aa, Artificial Sequence; identical to SEQ ID NO: 41
  Heavy chain 2

SEQ ID NO: 198 - protein, 343 aa, Artificial Sequence; identical to SEQ ID NO: 117
  Heavy chain 1

SEQ ID NO: 199 - protein, 232 aa, Artificial Sequence; identical to SEQ ID NO: 41
  Heavy chain 2

SEQ ID NO: 200 - protein, 343 aa, Artificial Sequence; identical to SEQ ID NO: 120
  Heavy chain 1

SEQ ID NO: 201 - protein, 232 aa, Artificial Sequence; identical to SEQ ID NO: 41
  Heavy chain 2

SEQ ID NO: 202 - protein, 445 aa, Artificial Sequence
  Heavy chain 1
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 203 - protein, 232 aa, Artificial Sequence; identical to SEQ ID NO: 72
  Heavy chain 2

SEQ ID NO: 204 - protein, 213 aa, Artificial Sequence; identical to SEQ ID NO: 13
  Light chain

SEQ ID NO: 205 - protein, 452 aa, Artificial Sequence
  Heavy chain
QVQLVQSGAEVKKPGASVKVSCKASGYTFTSYVIHWVRQAPGQGLEWMGYINPYNDGTDYDEKFQGRVTMTSDKSISTAYMELSRLRSDDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 219 aa, Artificial Sequence
  Light chain
DIVMTQSPDSLAVSLGERATINCKSSQSLLYSTNQKNYLAWYQQKPGQSPKLLIYWASTRESGVPDRFTGSGSGTDFTLTISSLQAEDVAVYYCQQYYSYRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 207 - protein, 364 aa, Artificial Sequence; identical to SEQ ID NO: 87
  Heavy chain 1

SEQ ID NO: 208 - protein, 447 aa, Artificial Sequence; identical to SEQ ID NO: 155
  Heavy chain 2

SEQ ID NO: 209 - protein, 215 aa, Artificial Sequence; identical to SEQ ID NO: 126
  Light chain

SEQ ID NO: 210 - protein, 364 aa, Artificial Sequence; identical to SEQ ID NO: 87
  Heavy chain 1

SEQ ID NO: 211 - protein, 447 aa, Artificial Sequence; identical to SEQ ID NO: 149
  Heavy chain 2

SEQ ID NO: 212 - protein, 219 aa, Artificial Sequence; identical to SEQ ID NO: 124
  Light chain

SEQ ID NO: 213 - protein, 364 aa, Artificial Sequence; identical to SEQ ID NO: 87
  Heavy chain 1

SEQ ID NO: 214 - protein, 451 aa, Artificial Sequence
  Heavy chain 2
QVQLVQSGAEVKKPGASVKVSCKASGYTFTSYVIHWVRQAPGQGLEWMGYINPYNDGTDYDEKFQGRVTMTSDKSISTAYMELSRLRSDDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 215 - protein, 219 aa, Artificial Sequence; identical to SEQ ID NO: 206
  Light chain

SEQ ID NO: 216 - protein, 451 aa, Artificial Sequence; identical to SEQ ID NO: 214
  Heavy chain 1

SEQ ID NO: 217 - protein, 473 aa, Artificial Sequence; identical to SEQ ID NO: 134
  Heavy chain 2

SEQ ID NO: 218 - protein, 219 aa, Artificial Sequence; identical to SEQ ID NO: 206
  Light chain

SEQ ID NO: 219 - protein, 451 aa, Artificial Sequence; identical to SEQ ID NO: 214
  Heavy chain 1

SEQ ID NO: 220 - protein, 231 aa, Artificial Sequence; identical to SEQ ID NO: 144
  Heavy chain 2

SEQ ID NO: 221 - protein, 219 aa, Artificial Sequence; identical to SEQ ID NO: 206
  Light chain

SEQ ID NO: 222 - protein, 443 aa, Artificial Sequence
  Heavy chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - protein, 214 aa, Artificial Sequence
  Light chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - protein, 364 aa, Artificial Sequence; identical to SEQ ID NO: 87
  Heavy chain 1

SEQ ID NO: 225 - protein, 442 aa, Artificial Sequence
  Heavy chain 2
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 226 - protein, 214 aa, Artificial Sequence; identical to SEQ ID NO: 223
  Light chain

SEQ ID NO: 227 - protein, 442 aa, Artificial Sequence; identical to SEQ ID NO: 225
  Heavy chain 1

SEQ ID NO: 228 - protein, 473 aa, Artificial Sequence; identical to SEQ ID NO: 134
  Heavy chain 2

SEQ ID NO: 229 - protein, 214 aa, Artificial Sequence; identical to SEQ ID NO: 223
  Light chain

SEQ ID NO: 230 - protein, 442 aa, Artificial Sequence; identical to SEQ ID NO: 225
  Heavy chain 1

SEQ ID NO: 231 - protein, 231 aa, Artificial Sequence; identical to SEQ ID NO: 144
  Heavy chain 2

SEQ ID NO: 232 - protein, 214 aa, Artificial Sequence; identical to SEQ ID NO: 223
  Light chain

SEQ ID NO: 233 - protein, 364 aa, Artificial Sequence
  Heavy chain 1
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 234 - protein, 447 aa, Artificial Sequence; identical to SEQ ID NO: 161
  Heavy chain 2

SEQ ID NO: 235 - protein, 215 aa, Artificial Sequence; identical to SEQ ID NO: 126
  Light chain

SEQ ID NO: 236 - protein, 364 aa, Artificial Sequence; identical to SEQ ID NO: 233
  Heavy chain 1

SEQ ID NO: 237 - protein, 447 aa, Artificial Sequence; identical to SEQ ID NO: 152
  Heavy chain 2

SEQ ID NO: 238 - protein, 219 aa, Artificial Sequence; identical to SEQ ID NO: 124
  Light chain

SEQ ID NO: 239 - protein, 364 aa, Artificial Sequence; identical to SEQ ID NO: 233
  Heavy chain 1

SEQ ID NO: 240 - protein, 451 aa, Artificial Sequence
  Heavy chain 2
QVQLVQSGAEVKKPGASVKVSCKASGYTFTSYVIHWVRQAPGQGLEWMGYINPYNDGTDYDEKFQGRVTMTSDKSISTAYMELSRLRSDDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - protein, 219 aa, Artificial Sequence; identical to SEQ ID NO: 206
  Light chain

SEQ ID NO: 242 - protein, 364 aa, Artificial Sequence; identical to SEQ ID NO: 233
  Heavy chain 1

SEQ ID NO: 243 - protein, 442 aa, Artificial Sequence
  Heavy chain 2
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 244 - protein, 214 aa, Artificial Sequence; identical to SEQ ID NO: 223
  Light chain

SEQ ID NO: 245 - protein, 448 aa, Artificial Sequence
  Heavy chain
QVKLQESGAELVKPGASVKLSCTASGFNIKDTYIHFVRQRPEQGLEWIGRIDPANDNTLYASKFQGKATITADTSSNTAYMHLSSLTSGDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - protein, 214 aa, Artificial Sequence
  Light chain
DIKMTQSPSFLAASPGETITINCRTSRSISQYLAWYQEKPGKTNKLLIYSGSTLQSGIPSRFSGSGSGTDFTLTISGLEPEDFAMYYCQQHNENPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 247 - protein, 448 aa, Artificial Sequence; identical to SEQ ID NO: 245
  Heavy chain

SEQ ID NO: 248 - protein, 214 aa, Artificial Sequence
  Light chain
DIKMTQSPSSLSASVGDRVTITCRTSRSISQYLAWYQEKPGKTNKLLIYSGSTLQSGIPSRFSGSGSGTDFTLTISSLQPEDFATYYCQQHNENPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - protein, 448 aa, Artificial Sequence
  Heavy chain
EVQLQQSGAEVKKPGASVKVSCKASGFNIKDTYIHWVRQAPGKGLEWMGRIDPANDNTLYASKFQGRVTITADTSTNTAYMELSSLRSEDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 250 - protein, 214 aa, Artificial Sequence; identical to SEQ ID NO: 246
  Light chain

SEQ ID NO: 251 - protein, 448 aa, Artificial Sequence; identical to SEQ ID NO: 249
  Heavy chain

SEQ ID NO: 252 - protein, 214 aa, Artificial Sequence; identical to SEQ ID NO: 248
  Light chain

SEQ ID NO: 253 - protein, 364 aa, Artificial Sequence; identical to SEQ ID NO: 87
  Heavy chain 1

SEQ ID NO: 254 - protein, 447 aa, Artificial Sequence
  Heavy chain 2
EVQLQQSGAEVKKPGASVKVSCKASGFNIKDTYIHWVRQAPGKGLEWMGRIDPANDNTLYASKFQGRVTITADTSTNTAYMELSSLRSEDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 255 - protein, 214 aa, Artificial Sequence; identical to SEQ ID NO: 248
  Light chain

SEQ ID NO: 256 - protein, 447 aa, Artificial Sequence; identical to SEQ ID NO: 254
  Heavy chain 1

SEQ ID NO: 257 - protein, 473 aa, Artificial Sequence; identical to SEQ ID NO: 134
  Heavy chain 2

SEQ ID NO: 258 - protein, 214 aa, Artificial Sequence; identical to SEQ ID NO: 248
  Light chain

SEQ ID NO: 259 - protein, 447 aa, Artificial Sequence; identical to SEQ ID NO: 254
  Heavy chain 1

SEQ ID NO: 260 - protein, 231 aa, Artificial Sequence; identical to SEQ ID NO: 144
  Heavy chain 2

SEQ ID NO: 261 - protein, 214 aa, Artificial Sequence; identical to SEQ ID NO: 248
  Light chain

SEQ ID NO: 262 - protein, 364 aa, Artificial Sequence; identical to SEQ ID NO: 233
  Heavy chain 1

SEQ ID NO: 263 - protein, 447 aa, Artificial Sequence
  Heavy chain 2
EVQLQQSGAEVKKPGASVKVSCKASGFNIKDTYIHWVRQAPGKGLEWMGRIDPANDNTLYASKFQGRVTITADTSTNTAYMELSSLRSEDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 264 - protein, 214 aa, Artificial Sequence; identical to SEQ ID NO: 248
  Light chain

SEQ ID NO: 265 - protein, 447 aa, Artificial Sequence; identical to SEQ ID NO: 263
  Heavy chain 1

SEQ ID NO: 266 - protein, 473 aa, Artificial Sequence
  Heavy chain 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGGGGSGGGGSGGGGSGGGGSQIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 267 - protein, 214 aa, Artificial Sequence; identical to SEQ ID NO: 248
  Light chain

SEQ ID NO: 268 - protein, 15 aa, Artificial Sequence
  Positive charged scFv linkers
GGGGSGGGGSGGGGS

SEQ ID NO: 269 - protein, 18 aa, Artificial Sequence
  Positive charged scFv linkers
GSTSGSGKPGSGEGSTKG

SEQ ID NO: 270 - protein, 14 aa, Artificial Sequence
  Positive charged scFv linkers
IRPRAIGGSKPRVA

SEQ ID NO: 271 - protein, 15 aa, Artificial Sequence
  Positive charged scFv linkers
GKGGSGKGGSGKGGS

SEQ ID NO: 272 - protein, 15 aa, Artificial Sequence
  Positive charged scFv linkers
GGKGSGGKGSGGKGS

SEQ ID NO: 273 - protein, 15 aa, Artificial Sequence
  Positive charged scFv linkers
GGGKSGGGKSGGGKS

SEQ ID NO: 274 - protein, 15 aa, Artificial Sequence
  Positive charged scFv linkers
GKGKSGKGKSGKGKS

SEQ ID NO: 275 - protein, 15 aa, Artificial Sequence
  Positive charged scFv linkers
GGGKSGGKGSGKGGS

SEQ ID NO: 276 - protein, 15 aa, Artificial Sequence
  Positive charged scFv linkers
GKPGSGKPGSGKPGS

SEQ ID NO: 277 - protein, 20 aa, Artificial Sequence
  Positive charged scFv linkers
GKPGSGKPGSGKPGSGKPGS

SEQ ID NO: 278 - protein, 20 aa, Artificial Sequence
  Positive charged scFv linkers
GKGKSGKGKSGKGKSGKGKS

SEQ ID NO: 279 - protein, 20 aa, Artificial Sequence
  Negative charged scFv linkers
GGGGSGGGGSGGGGSGGGGS

SEQ ID NO: 280 - protein, 14 aa, Artificial Sequence
  Negative charged scFv linkers
STAGDTHLGGEDFD

SEQ ID NO: 281 - protein, 15 aa, Artificial Sequence
  Negative charged scFv linkers
GEGGSGEGGSGEGGS

SEQ ID NO: 282 - protein, 15 aa, Artificial Sequence
  Negative charged scFv linkers
GGEGSGGEGSGGEGS

SEQ ID NO: 283 - protein, 15 aa, Artificial Sequence
  Negative charged scFv linkers
GGGESGGGESGGGES

SEQ ID NO: 284 - protein, 15 aa, Artificial Sequence
  Negative charged scFv linkers
GEGESGEGESGEGES

SEQ ID NO: 285 - protein, 15 aa, Artificial Sequence
  Negative charged scFv linkers
GGGESGGEGSGEGGS

SEQ ID NO: 286 - protein, 20 aa, Artificial Sequence
  Negative charged scFv linkers
GEGESGEGESGEGESGEGES

SEQ ID NO: 287 - protein, 20 aa, Artificial Sequence
  charged scFv linker
GKPGSGKPGSGKPGSGKPGS

SEQ ID NO: 288 - protein, 450 aa, Artificial Sequence
  Monomer 1
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGAYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 289 - protein, 5 aa, Artificial Sequence
  vhCDR1
NYAMS

SEQ ID NO: 290 - protein, 17 aa, Artificial Sequence
  vhCDR2
AISDHSTNTYYPDSVKG

SEQ ID NO: 291 - protein, 11 aa, Artificial Sequence
  vhCDR3
KYGGAYDPFDY

SEQ ID NO: 292 - protein, 120 aa, Artificial Sequence
  vh
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGAYDPFDYWGQGTLVTVSS

SEQ ID NO: 293 - protein, 474 aa, Artificial Sequence
  Monomer 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGKPGSGKPGSGKPGSGKPGSQIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 5 aa, Artificial Sequence
  vhCDR1
SYRMH

SEQ ID NO: 295 - protein, 17 aa, Artificial Sequence
  vhCDR2
YINPSTGYTEYNQKFQG

SEQ ID NO: 296 - protein, 7 aa, Artificial Sequence
  vhCDR3
GGGVFDY

SEQ ID NO: 297 - protein, 116 aa, Artificial Sequence
  vh
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSS

SEQ ID NO: 298 - protein, 10 aa, Artificial Sequence
  vLCDR1
RASSSISYMH

SEQ ID NO: 299 - protein, 7 aa, Artificial Sequence
  vlCDR2
DTSNLAS

SEQ ID NO: 300 - protein, 9 aa, Artificial Sequence
  vlCDR3
HQRSTYPLT

SEQ ID NO: 301 - protein, 106 aa, Artificial Sequence
  vl
QIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIK

SEQ ID NO: 302 - protein, 242 aa, Artificial Sequence
  scFv
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGKPGSGKPGSGKPGSGKPGSQIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIK

SEQ ID NO: 303 - protein, 214 aa, Artificial Sequence; identical to SEQ ID NO: 38
  Light chain

SEQ ID NO: 304 - protein, 12 aa, Artificial Sequence
  vLCDR1
CQASQDINNYIA

SEQ ID NO: 305 - protein, 7 aa, Artificial Sequence
  vlCDR2
YTSTLQP

SEQ ID NO: 306 - protein, 9 aa, Artificial Sequence
  vlCDR3
LQYDNLLFT

SEQ ID NO: 307 - protein, 107 aa, Artificial Sequence
  vl
DIQMTQSPSSLSASVGDRVTITCQASQDINNYIAWYQHKPGKGPKLLIHYTSTLQPGIPSRFSGSGSGRDYTLTISSLQPEDFATYYCLQYDNLLFTFGGGTKVEIK

SEQ ID NO: 308 - protein, 448 aa, Artificial Sequence
  Monomer 1
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 309 - protein, 5 aa, Artificial Sequence
  vhCDR1
SYYIQ

SEQ ID NO: 310 - protein, 16 aa, Artificial Sequence
  vhCDR2
WINPGNVNTKYNEKFQ

SEQ ID NO: 311 - protein, 9 aa, Artificial Sequence
  vhCDR3
STYYRPLDY

SEQ ID NO: 312 - protein, 118 aa, Artificial Sequence
  vh
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPLDYWGQGTTVTVSS

SEQ ID NO: 313 - protein, 219 aa, Artificial Sequence
  Light chain
DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 314 - protein, 17 aa, Artificial Sequence
  vLCDR1
KSSQSILYSSNQKNYLA

SEQ ID NO: 315 - protein, 7 aa, Artificial Sequence
  vlCDR2
WASTRES

SEQ ID NO: 316 - protein, 7 aa, Artificial Sequence
  vlCDR3
HQYLSSY

SEQ ID NO: 317 - protein, 112 aa, Artificial Sequence
  vl
DIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLEIK

SEQ ID NO: 318 - protein, 448 aa, Artificial Sequence
  Monomer 1
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 319 - protein, 5 aa, Artificial Sequence
  vhCDR1
SYYIQ

SEQ ID NO: 320 - protein, 17 aa, Artificial Sequence
  vhCDR2
WINPGNVNTKYNEKFQG

SEQ ID NO: 321 - protein, 9 aa, Artificial Sequence
  vhCDR3
STYYIPLDY

SEQ ID NO: 322 - protein, 118 aa, Artificial Sequence
  vh
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPLDYWGQGTTVTVSS

SEQ ID NO: 323 - protein, 219 aa, Artificial Sequence
  Light chain
DIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 324 - protein, 17 aa, Artificial Sequence
  vLCDR1
KSSQSILYSKNQKNYLA

SEQ ID NO: 325 - protein, 7 aa, Artificial Sequence
  vlCDR2
WASTRES

SEQ ID NO: 326 - protein, 8 aa, Artificial Sequence
  vlCDR3
HQYLSSYT

SEQ ID NO: 327 - protein, 112 aa, Artificial Sequence
  vl
DIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLEIK

SEQ ID NO: 328 - protein, 448 aa, Artificial Sequence
  Monomer 1
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 329 - protein, 5 aa, Artificial Sequence
  vhCDR1
SYTMH

SEQ ID NO: 330 - protein, 17 aa, Artificial Sequence
  vhCDR2
FISYDGNNKYYADSVKG

SEQ ID NO: 331 - protein, 9 aa, Artificial Sequence
  vhCDR3
TGWLGPFDY

SEQ ID NO: 332 - protein, 118 aa, Artificial Sequence
  vh
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 333 - protein, 215 aa, Artificial Sequence; identical to SEQ ID NO: 126
  light chain

SEQ ID NO: 334 - protein, 12 aa, Artificial Sequence
  vLCDR1
RASQSVGSSYLA

SEQ ID NO: 335 - protein, 7 aa, Artificial Sequence
  vlCDR2
GAFSRAT

SEQ ID NO: 336 - protein, 9 aa, Artificial Sequence
  vlCDR3
QQYGSSPWT

SEQ ID NO: 337 - protein, 108 aa, Artificial Sequence
  vl
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 338 - protein, 448 aa, Artificial Sequence; identical to SEQ ID NO: 328
  Monomer 1

SEQ ID NO: 339 - protein, 5 aa, Artificial Sequence
  vhCDR1
SYTMH

SEQ ID NO: 340 - protein, 17 aa, Artificial Sequence
  vhCDR2
FISYDGNNKYYADSVKG

SEQ ID NO: 341 - protein, 9 aa, Artificial Sequence
  vhCDR3
TGWLGPFDY

SEQ ID NO: 342 - protein, 118 aa, Artificial Sequence; identical to SEQ ID NO: 332
  vh

SEQ ID NO: 343 - protein, 474 aa, Artificial Sequence
  Monomer 2
QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFDYWGQGTLVTVSSGKPGSGKPGSGKPGSGKPGSQIVLTQSPATLSLSPGERATLSCRASSSISYMHWFQQKPGQSPQLLIYDASNLASGVPARFSGSGSGTDYTLTISSLQPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 344 - protein, 5 aa, Artificial Sequence
  vhCDR1
SYYMH

SEQ ID NO: 345 - protein, 17 aa, Artificial Sequence
  vhCDR2
YINPSTGYTEYNQKFQG

SEQ ID NO: 346 - protein, 7 aa, Artificial Sequence
  vhCDR3
GGGVFDY

SEQ ID NO: 347 - protein, 116 aa, Artificial Sequence
  vh
QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFDYWGQGTLVTVSS

SEQ ID NO: 348 - protein, 10 aa, Artificial Sequence
  vLCDR1
RASSSISYMH

SEQ ID NO: 349 - protein, 7 aa, Artificial Sequence
  vlCDR2
DASNLAS

SEQ ID NO: 350 - protein, 9 aa, Artificial Sequence
  vlCDR3
HQRSTYPLT

SEQ ID NO: 351 - protein, 106 aa, Artificial Sequence
  vl
QIVLTQSPATLSLSPGERATLSCRASSSISYMHWFQQKPGQSPQLLIYDASNLASGVPARFSGSGSGTDYTLTISSLQPEDFAVYYCHQRSTYPLTFGSGTKLEIK

SEQ ID NO: 352 - protein, 242 aa, Artificial Sequence
  scFv
QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFDYWGQGTLVTVSSGKPGSGKPGSGKPGSGKPGSQIVLTQSPATLSLSPGERATLSCRASSSISYMHWFQQKPGQSPQLLIYDASNLASGVPARFSGSGSGTDYTLTISSLQPEDFAVYYCHQRSTYPLTFGSGTKLEIK

SEQ ID NO: 353 - protein, 455 aa, Artificial Sequence
  Monomer 1
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 354 - protein, 5 aa, Artificial Sequence
  vhCDR1
SYGMH

SEQ ID NO: 355 - protein, 17 aa, Artificial Sequence
  vhCDR2
VIWYDGSNKYYADSVKG

SEQ ID NO: 356 - protein, 16 aa, Artificial Sequence
  vhCDR3
DPRGATLYYYYYGMDV

SEQ ID NO: 357 - protein, 125 aa, Artificial Sequence
  vh
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 358 - protein, 482 aa, Artificial Sequence
  Monomer 2
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPLDYWGQGTTVTVSSGKPGSGKPGSGKPGSGKPGSDIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLEIKEPKSSDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - protein, 5 aa, Artificial Sequence
  vhCDR1
SYYIQ

SEQ ID NO: 360 - protein, 17 aa, Artificial Sequence
  vhCDR2
WINPGNVNTKYNEKFQG

SEQ ID NO: 361 - protein, 9 aa, Artificial Sequence
  vhCDR3
STYYIPLDY

SEQ ID NO: 362 - protein, 118 aa, Artificial Sequence; identical to SEQ ID NO: 322
  vh

SEQ ID NO: 363 - protein, 17 aa, Artificial Sequence
  vLCDR1
KSSQSILYSKNQKNYLA

SEQ ID NO: 364 - protein, 7 aa, Artificial Sequence
  vlCDR2
WASTRES

SEQ ID NO: 365 - protein, 8 aa, Artificial Sequence
  vlCDR3
HQYLSSYT

SEQ ID NO: 366 - protein, 112 aa, Artificial Sequence; identical to SEQ ID NO: 327
  vl

SEQ ID NO: 367 - protein, 250 aa, Artificial Sequence
  scFv
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPLDYWGQGTTVTVSSGKPGSGKPGSGKPGSGKPGSDIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLEIK

SEQ ID NO: 368 - protein, 214 aa, Artificial Sequence
  Light chain
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 369 - protein, 11 aa, Artificial Sequence
  vLCDR1
RASQSINSYLD

SEQ ID NO: 370 - protein, 8 aa, Artificial Sequence
  vlCDR2
AASSLQSS

SEQ ID NO: 371 - protein, 10 aa, Artificial Sequence
  vlCDR3
QQYYSTPFTF

SEQ ID NO: 372 - protein, 107 aa, Artificial Sequence
  vl
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK

SEQ ID NO: 373 - protein, 446 aa, Artificial Sequence
  Heavy chain
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKCKVSNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 374 - protein, 213 aa, Artificial Sequence
  Light chain
QIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 375 - protein, 448 aa, Artificial Sequence
  Heavy chain
QVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKCKVSNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 376 - protein, 219 aa, Artificial Sequence
  Light chain
DIELTQSPDSLAVSLGERATINCKSSQSILYSSNQKNYLAWYQQKPGQSPKLLIYWASTRESGVPDRFTGSGSGTDFTLTISSLQAEDVAVYYCHQYLSSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 377 - protein, 446 aa, Artificial Sequence; identical to SEQ ID NO: 46
  Heavy chain

SEQ ID NO: 378 - protein, 213 aa, Artificial Sequence; identical to SEQ ID NO: 47
  Light chain

SEQ ID NO: 379 - protein, 446 aa, Artificial Sequence
  Heavy chain
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLRGPSVFLFPPKPKDTLMISRTPEVTCVVVDVSHEDPEVKFNWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 380 - protein, 213 aa, Artificial Sequence; identical to SEQ ID NO: 47
  Light chain

SEQ ID NO: 381 - protein, 446 aa, Artificial Sequence; identical to SEQ ID NO: 12
  Heavy chain

SEQ ID NO: 382 - protein, 213 aa, Artificial Sequence; identical to SEQ ID NO: 374
  Light chain

SEQ ID NO: 383 - protein, 446 aa, Artificial Sequence
  Heavy chain
QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 384 - protein, 213 aa, Artificial Sequence
  Light chain
QIVLTQSPATLSLSPGERATLSCRASSSISYMHWFQQKPGQSPQLLIYDASNLASGVPARFSGSGSGTDYTLTISSLQPEDFAVYYCHQRSTYPLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 385 - protein, 446 aa, Artificial Sequence
  Heavy chain
QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKCKVSNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 386 - protein, 213 aa, Artificial Sequence; identical to SEQ ID NO: 384
  Light chain

SEQ ID NO: 387 - protein, 450 aa, Artificial Sequence
  Heavy chain 1
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 388 - protein, 478 aa, Artificial Sequence
  Heavy chain 2
QVQLVESGGGLVQPGGSLRLSCAASGFTFSSFGMHWVRQAPGKGLEWVSYISSGSSIIYYADSRKGRFTISRDNAKNSLYLQMNSLRAEDTAVYYCARWSTTVVATDYWGQGTTVTVSSGKPGSGKPGSGKPGSGKPGSNIVMTQSPATLSVSPGERATLSCRASENVVTYVSWYQQKPGQSPRLLIYGASNRYTGVPDRFTGSGSATDFTLTISSLQPEDFAVYHCGQGYSYPYTFGGGTKLEIKEPKSSDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 389 - protein, 214 aa, Artificial Sequence; identical to SEQ ID NO: 38
  Light chain

SEQ ID NO: 390 - protein, 450 aa, Artificial Sequence
  Heavy chain 1
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGDYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 391 - protein, 478 aa, Artificial Sequence
  Heavy chain 2
QVQLVESGGGLVQPGGSLRLSCAASGFTFSSFGMHWVRQAPGKGLEWVSYISSGSSIIYYADSRKGRFTISRDNAKNSLYLQMNSLRAEDTAVYYCARWSTTVVATDYWGQGTTVTVSSGKPGSGKPGSGKPGSGKPGSNIVMTQSPATLSVSPGERATLSCRASENVVTYVSWYQQKPGQSPRLLIYGASNRYTGVPDRFTGSGSATDFTLTISSLQPEDFAVYHCGQGYSYPYTFGGGTKLEIKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 392 - protein, 214 aa, Artificial Sequence; identical to SEQ ID NO: 38
  Light chain

SEQ ID NO: 393 - protein, 448 aa, Artificial Sequence; identical to SEQ ID NO: 308
  Heavy chain 1

SEQ ID NO: 394 - protein, 478 aa, Artificial Sequence; identical to SEQ ID NO: 388
  Heavy chain 2

SEQ ID NO: 395 - protein, 219 aa, Artificial Sequence; identical to SEQ ID NO: 313
  Light chain

SEQ ID NO: 396 - protein, 448 aa, Artificial Sequence; identical to SEQ ID NO: 318
  Heavy chain 1

SEQ ID NO: 397 - protein, 478 aa, Artificial Sequence; identical to SEQ ID NO: 388
  Heavy chain 2

SEQ ID NO: 398 - protein, 219 aa, Artificial Sequence; identical to SEQ ID NO: 323
  Light chain

SEQ ID NO: 399 - protein, 448 aa, Artificial Sequence; identical to SEQ ID NO: 328
  Heavy chain 1

SEQ ID NO: 400 - protein, 478 aa, Artificial Sequence; identical to SEQ ID NO: 388
  Heavy chain 2

SEQ ID NO: 401 - protein, 215 aa, Artificial Sequence; identical to SEQ ID NO: 126
  Light chain

SEQ ID NO: 402 - protein, 448 aa, Artificial Sequence
  Heavy chain 1
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 403 - protein, 478 aa, Artificial Sequence; identical to SEQ ID NO: 391
  Heavy chain 2

SEQ ID NO: 404 - protein, 215 aa, Artificial Sequence; identical to SEQ ID NO: 126
  Light chain

SEQ ID NO: 405 - protein, 448 aa, Artificial Sequence
  Heavy chain 1
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 406 - protein, 478 aa, Artificial Sequence; identical to SEQ ID NO: 391
  Heavy chain 2

SEQ ID NO: 407 - protein, 219 aa, Artificial Sequence; identical to SEQ ID NO: 323
  Light chain

SEQ ID NO: 408 - protein, 446 aa, Artificial Sequence
  Heavy chain 1
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 409 - protein, 481 aa, Artificial Sequence
  Heavy chain 2
EVQLLGSGGGLVQPGGSLRLSCAASGFTFTTYYMHWVRQAPGKGLEWVSLISPNAGNTYYADSVKGRFTISRDNSKNTLYLQMNSLRAEDTAVYYCARGRSRAGTSGMDYWGQGTLVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTDFTLTISRLEPEDFAVYYCQQAASSPITFGQGTKVEIKEPKSSDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 410 - protein, 213 aa, Artificial Sequence; identical to SEQ ID NO: 13
  Light chain

SEQ ID NO: 411 - protein, 445 aa, Artificial Sequence
  Heavy chain 1
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 412 - protein, 480 aa, Artificial Sequence
  Heavy chain 2
EVQLLGSGGGLVQPGGSLRLSCAASGFTFTTYYMHWVRQAPGKGLEWVSLISPNAGNTYYADSVKGRFTISRDNSKNTLYLQMNSLRAEDTAVYYCARGRSRAGTSGMDYWGQGTLVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTDFTLTISRLEPEDFAVYYCQQAASSPITFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 213 aa, Artificial Sequence; identical to SEQ ID NO: 13
  Light chain

SEQ ID NO: 414 - protein, 448 aa, Artificial Sequence; identical to SEQ ID NO: 328
  Heavy chain 1

SEQ ID NO: 415 - protein, 481 aa, Artificial Sequence; identical to SEQ ID NO: 409
  Heavy chain 2

SEQ ID NO: 416 - protein, 215 aa, Artificial Sequence; identical to SEQ ID NO: 126
  Light chain

SEQ ID NO: 417 - protein, 447 aa, Artificial Sequence; identical to SEQ ID NO: 155
  Heavy chain 1

SEQ ID NO: 418 - protein, 480 aa, Artificial Sequence; identical to SEQ ID NO: 412
  Heavy chain 2

SEQ ID NO: 419 - protein, 215 aa, Artificial Sequence; identical to SEQ ID NO: 126
  Light chain

SEQ ID NO: 420 - protein, 448 aa, Artificial Sequence; identical to SEQ ID NO: 308
  Heavy chain 1

SEQ ID NO: 421 - protein, 481 aa, Artificial Sequence; identical to SEQ ID NO: 409
  Heavy chain 2

SEQ ID NO: 422 - protein, 219 aa, Artificial Sequence; identical to SEQ ID NO: 313
  Light chain

SEQ ID NO: 423 - protein, 447 aa, Artificial Sequence
  Heavy chain 1
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 424 - protein, 480 aa, Artificial Sequence; identical to SEQ ID NO: 412
  Heavy chain 2

SEQ ID NO: 425 - protein, 219 aa, Artificial Sequence; identical to SEQ ID NO: 313
  Light chain

SEQ ID NO: 426 - protein, 450 aa, Artificial Sequence; identical to SEQ ID NO: 387
  Heavy chain 1

SEQ ID NO: 427 - protein, 481 aa, Artificial Sequence; identical to SEQ ID NO: 409
  Heavy chain 2

SEQ ID NO: 428 - protein, 214 aa, Artificial Sequence; identical to SEQ ID NO: 38
  Light chain

SEQ ID NO: 429 - protein, 452 aa, Artificial Sequence
  Heavy chain 1
QVTLKESGPGILKPSQTLSLTCSFSGFSLSTSGMGVGWIRQPSGKGLEWLAHIWWDDDKYYSPSLKSQLTISKDTSRNQVFLKITSLDTADTATYYCVRSYYYGSSGAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 430 - protein, 482 aa, Artificial Sequence
  Heavy chain 2
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPLDYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLEIKEPKSSDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 431 - protein, 219 aa, Artificial Sequence
  Light chain
DIVMTQTPLSLPVSLGDQASISCRSSQSLVHSDGNTYLHWYLQKPGQSPKLLIYKVSKRFSGVPDRFSGSGSGTDFTLKISRVEAEDLGVYFCSQSTHVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 432 - protein, 452 aa, Artificial Sequence; identical to SEQ ID NO: 429
  Heavy chain 1

SEQ ID NO: 433 - protein, 478 aa, Artificial Sequence
  Heavy chain 2
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKEPKSSDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 434 - protein, 219 aa, Artificial Sequence; identical to SEQ ID NO: 431
  Light chain

SEQ ID NO: 435 - protein, 451 aa, Artificial Sequence
  Heavy chain 1
QVTLKESGPGILKPSQTLSLTCSFSGFSLSTSGMGVGWIRQPSGKGLEWLAHIWWDDDKYYSPSLKSQLTISKDTSRNQVFLKITSLDTADTATYYCVRSYYYGSSGAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 436 - protein, 481 aa, Artificial Sequence
  Heavy chain 2
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPLDYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 437 - protein, 250 aa, Artificial Sequence
  scFv
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYRPLDYWGQGTTVTVSSGKPGSGKPGSGKPGSGKPGSDIELTQSPDSLAVSLGERATINCKSSQSILYSSNQKNYLAWYQQKPGQSPKLLIYWASTRESGVPDRFTGSGSGTDFTLTISSLEAEDVAVYYCHQYLSSYTFGGGTKLEIK

SEQ ID NO: 438 - protein, 219 aa, Artificial Sequence; identical to SEQ ID NO: 431
  Light chain

SEQ ID NO: 439 - protein, 451 aa, Artificial Sequence; identical to SEQ ID NO: 435
  Heavy chain 1

SEQ ID NO: 440 - protein, 477 aa, Artificial Sequence
  Heavy chain 2
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 441 - protein, 219 aa, Artificial Sequence; identical to SEQ ID NO: 431
  Light chain

SEQ ID NO: 442 - protein, 448 aa, Artificial Sequence
  Heavy chain 1
EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 443 - protein, 482 aa, Artificial Sequence; identical to SEQ ID NO: 430
  Heavy chain 2

SEQ ID NO: 444 - protein, 250 aa, Artificial Sequence; identical to SEQ ID NO: 437
  scFV

SEQ ID NO: 445 - protein, 214 aa, Artificial Sequence
  Light chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - protein, 448 aa, Artificial Sequence; identical to SEQ ID NO: 442
  Heavy chain 1

SEQ ID NO: 447 - protein, 478 aa, Artificial Sequence; identical to SEQ ID NO: 433
  Heavy chain 2

SEQ ID NO: 448 - protein, 214 aa, Artificial Sequence; identical to SEQ ID NO: 445
  Light chain

SEQ ID NO: 449 - protein, 447 aa, Artificial Sequence
  Heavy chain 1
EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 450 - protein, 481 aa, Artificial Sequence; identical to SEQ ID NO: 436
  Heavy chain 2

SEQ ID NO: 451 - protein, 214 aa, Artificial Sequence; identical to SEQ ID NO: 445
  Light chain

SEQ ID NO: 452 - protein, 447 aa, Artificial Sequence; identical to SEQ ID NO: 449
  Heavy chain 1

SEQ ID NO: 453 - protein, 477 aa, Artificial Sequence; identical to SEQ ID NO: 440
  Heavy chain 2

SEQ ID NO: 454 - protein, 214 aa, Artificial Sequence; identical to SEQ ID NO: 445
  Light chain

SEQ ID NO: 455 - protein, 448 aa, Artificial Sequence; identical to SEQ ID NO: 328
  Heavy chain 1

SEQ ID NO: 456 - protein, 482 aa, Artificial Sequence; identical to SEQ ID NO: 430
  Heavy chain 2

SEQ ID NO: 457 - protein, 215 aa, Artificial Sequence; identical to SEQ ID NO: 126
  Light chain

SEQ ID NO: 458 - protein, 447 aa, Artificial Sequence; identical to SEQ ID NO: 155
  Heavy chain 1

SEQ ID NO: 459 - protein, 481 aa, Artificial Sequence; identical to SEQ ID NO: 436
  Heavy chain 2

SEQ ID NO: 460 - protein, 215 aa, Artificial Sequence; identical to SEQ ID NO: 126
  Light chain

SEQ ID NO: 461 - protein, 448 aa, Artificial Sequence; identical to SEQ ID NO: 308
  Heavy chain 1

SEQ ID NO: 462 - protein, 478 aa, Artificial Sequence; identical to SEQ ID NO: 433
  Heavy chain 2

SEQ ID NO: 463 - protein, 219 aa, Artificial Sequence; identical to SEQ ID NO: 313
  Light chain

SEQ ID NO: 464 - protein, 447 aa, Artificial Sequence; identical to SEQ ID NO: 423
  Heavy chain 1

SEQ ID NO: 465 - protein, 477 aa, Artificial Sequence; identical to SEQ ID NO: 440
  Heavy chain 2

SEQ ID NO: 466 - protein, 219 aa, Artificial Sequence; identical to SEQ ID NO: 313
  Light chain

SEQ ID NO: 467 - protein, 450 aa, Artificial Sequence; identical to SEQ ID NO: 387
  Heavy chain 1

SEQ ID NO: 468 - protein, 474 aa, Artificial Sequence; identical to SEQ ID NO: 343
  Heavy chain 2

SEQ ID NO: 469 - protein, 214 aa, Artificial Sequence; identical to SEQ ID NO: 38
  Light chain

SEQ ID NO: 470 - protein, 450 aa, Artificial Sequence
  Heavy chain 1
QVQLQQWGAGLLKPSETLSLTCAVYGGSFSDYYWNWIRQPPGKGLEWIGEINHNGNTNSNPSLKSRVTLSLDTSKNQFSLKLRSVTAADTAVYYCAFGYSDYEYNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 471 - protein, 482 aa, Artificial Sequence; identical to SEQ ID NO: 430
  Heavy chain 2

SEQ ID NO: 472 - protein, 214 aa, Artificial Sequence
  Light chain
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 473 - protein, 449 aa, Artificial Sequence
  Heavy chain 1
QVQLQQWGAGLLKPSETLSLTCAVYGGSFSDYYWNWIRQPPGKGLEWIGEINHNGNTNSNPSLKSRVTLSLDTSKNQFSLKLRSVTAADTAVYYCAFGYSDYEYNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 474 - protein, 481 aa, Artificial Sequence; identical to SEQ ID NO: 436
  Heavy chain 2

SEQ ID NO: 475 - protein, 214 aa, Artificial Sequence; identical to SEQ ID NO: 472
  Light chain

SEQ ID NO: 476 - protein, 455 aa, Artificial Sequence
  Heavy chain 1
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 477 - protein, 482 aa, Artificial Sequence
  Heavy chain 2
EVQLVQSGAEVKKPGASVKVSCKASGYTFASYYIQWMRQAPGQGLEWMGWINPGNVNTKYNEKFQGRVTITADKSITTAYMELSSLRSEDTAVYFCARSTYYIPLDYWGQGTTVTVSSGKPGSGKPGSGKPGSGKPGSDIELTQSPDSLAVSLGERATINCKSSQSILYSKNQKNYLAWYQQKPGQSPKLLIYWASTRESGVPDRFTGSGSGTDFTLTISSLEAEDVAVYYCHQYLSSYTFGGGTKLEIKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 478 - protein, 214 aa, Artificial Sequence; identical to SEQ ID NO: 368
  Light chain

SEQ ID NO: 479 - protein, 448 aa, Artificial Sequence; identical to SEQ ID NO: 405
  Heavy chain 1

SEQ ID NO: 480 - protein, 474 aa, Artificial Sequence
  Heavy chain 2
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGKPGSGKPGSGKPGSGKPGSQIVLTQSPATLSLSPGERATLSCRASSSISYMHWFQQKPGQSPQLLIYDTSNLASGVPARFSGSGSGTDYTLTISSLQPEDFAVYYCHQRSTYPLTFGSGTKLEIKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - protein, 219 aa, Artificial Sequence; identical to SEQ ID NO: 323
  Light chain

SEQ ID NO: 482 - protein, 448 aa, Artificial Sequence; identical to SEQ ID NO: 402
  Heavy chain 1

SEQ ID NO: 483 - protein, 474 aa, Artificial Sequence
  Heavy chain 2
QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFDYWGQGTLVTVSSGKPGSGKPGSGKPGSGKPGSQIVLTQSPATLSLSPGERATLSCRASSSISYMHWFQQKPGQSPQLLIYDASNLASGVPARFSGSGSGTDYTLTISSLQPEDFAVYYCHQRSTYPLTFGSGTKLEIKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 484 - protein, 215 aa, Artificial Sequence; identical to SEQ ID NO: 126
  Light chain

SEQ ID NO: 485 - protein, 450 aa, Artificial Sequence
  Heavy chain 1
EVQLVESGGGLVQPGGSLRLSCAASGFTFSNYAMSWVRQAPGKRLEWVSAISDHSTNTYYPDSVKGRFTISRDNAKNTLYLQMNSLRAEDTAVYYCARKYGGAYDPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 486 - protein, 474 aa, Artificial Sequence; identical to SEQ ID NO: 480
  Heavy chain 2

SEQ ID NO: 487 - protein, 214 aa, Artificial Sequence; identical to SEQ ID NO: 38
  Light chain

SEQ ID NO: 488 - protein, 450 aa, Artificial Sequence; identical to SEQ ID NO: 288
  Heavy chain

SEQ ID NO: 489 - protein, 474 aa, Artificial Sequence
  Heavy chain
QVQLVQSGAEVKKPGASVKVSCKASGYTFTSYRMHWVRQAPGQGLEWMGYINPSTGYTEYNQKFQGRVTITADKSISTAYMELSRLRSDDTAVYYCARGGGVFDYWGQGTLVTVSSGKPGSGKPGSGKPGSGKPGSQIVLTQSPATLSLSPGERATLSCRASSSISYMHWFQQKPGQSPQLLIYTTSNLASGVPARFSGSGSGTDYTLTISSLQPEDFAVYYCHQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 490 - protein, 214 aa, Artificial Sequence; identical to SEQ ID NO: 38
  Light chain

SEQ ID NO: 491 - protein, 453 aa, Artificial Sequence
  Heavy chain
QIQLVQSGSELKKPGASVKVSCKASGYTFTNYGMNWVRQAPGQGLEWMGWINTNTGEPTYAEGFTGRFVFSLDTSVTTAYLQISSLKAEDTAVYFCARLGIYYDYGYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 492 - protein, 474 aa, Artificial Sequence; identical to SEQ ID NO: 489
  Heavy chain

SEQ ID NO: 493 - protein, 218 aa, Artificial Sequence
  Light chain
NIVLTQSPATLSLSPGERATLSCRASESVDSYGNSFMHWYQQKPGQPPRLLIYLASNLESGVPARFSGSGSRTDFTLTISSLEPEDFAVYYCQQNNEDPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 494 - protein, 453 aa, Artificial Sequence; identical to SEQ ID NO: 491
  Heavy chain

SEQ ID NO: 495 - protein, 474 aa, Artificial Sequence
  Heavy chain
QVQLVQSGAEVKKPGASVKVSCKASGYTFTSYYMHWVRQAPGQGLEWMGYINPSTGYTEYNQKFQGRVTITADKSISTAYMELSRLRSDDTAVYYCARGGGVFDYWGQGTLVTVSSGKPGSGKPGSGKPGSGKPGSQIVLTQSPATLSLSPGERATLSCRASSSISYMHWFQQKPGQSPQLLIYTTSNLASGVPARFSGSGSGTDYTLTISSLQPEDFAVYYCQQRSTYPLTFGSGTKLEIKEPKSSDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 496 - protein, 218 aa, Artificial Sequence; identical to SEQ ID NO: 493
  Light chain

SEQ ID NO: 497 - protein, 448 aa, Artificial Sequence; identical to SEQ ID NO: 308
  Heavy chain

SEQ ID NO: 498 - protein, 474 aa, Artificial Sequence; identical to SEQ ID NO: 489
  Heavy chain

SEQ ID NO: 499 - protein, 219 aa, Artificial Sequence; identical to SEQ ID NO: 313
  Light chain

SEQ ID NO: 500 - protein, 448 aa, Artificial Sequence; identical to SEQ ID NO: 328
  Heavy chain

SEQ ID NO: 501 - protein, 474 aa, Artificial Sequence; identical to SEQ ID NO: 489
  Heavy chain

SEQ ID NO: 502 - protein, 215 aa, Artificial Sequence; identical to SEQ ID NO: 126
  light chain

SEQ ID NO: 503 - protein, 443 aa, Artificial Sequence
  Heavy chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPDVFLFPPKPKDTLMISRTPEVTCVVVDVSHEDPEVKFNWYVDGVEVHNAKTKPREEEYNSTYRVVSVLTVLHQDWLNGKEYKCKVSNKALPAPEEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 504 - protein, 474 aa, Artificial Sequence; identical to SEQ ID NO: 489
  Heavy chain

SEQ ID NO: 505 - protein, 214 aa, Artificial Sequence; identical to SEQ ID NO: 223
  Light chain

SEQ ID NO: 506 - protein, 443 aa, Artificial Sequence; identical to SEQ ID NO: 503
  Heavy chain

SEQ ID NO: 507 - protein, 474 aa, Artificial Sequence; identical to SEQ ID NO: 293
  Heavy chain

SEQ ID NO: 508 - protein, 214 aa, Artificial Sequence; identical to SEQ ID NO: 223
  Light chain

SEQ ID NO: 509 - protein, 4 aa, Artificial Sequence
  petidyl linker
GFLG

We claim:

1. A heterodimeric antibody comprising:
   a) a first monomer comprising:
      i) a first variant IgG Fc domain; and
      ii) an anti-CD25 single chain variable fragment (scFv), said anti-CD25 scFv comprising a first variable heavy chain having the amino acid sequence of SEQ ID NO: 297, a first variable light chain having the amino acid sequence of SEQ ID NO: 301, and a linker that attaches said first variable heavy chain with said first variable light chain;
   b) a second monomer comprising:
      i) a VH-CH1-hinge-CH2-CH3 monomer, wherein VH is a second variable heavy chain and CH2-CH3 is a second variant IgG Fc domain; and
   c) a light chain monomer comprising a second variable light chain,
   wherein said first variant IgG Fc domain comprises amino acid substitutions S364K/E357Q and second variant IgG Fc domain comprises amino acid substitutions L368D/K370S, and wherein numbering is according to the EU index as in Kabat.

2. The heterodimeric antibody of claim 1, wherein said linker is a charged linker.

3. The heterodimeric antibody of claim 2, wherein said charged linker comprises amino acid sequence GKPGSGKPGSGKPGSGKPGS.

4. The heterodimeric antibody of claim 1, wherein said second variable heavy chain has the amino acid sequence of SEQ ID NO: 322 and the second variable light chain has the amino acid sequence of SEQ ID NO: 327.

5. A nucleic acid composition comprising:
   a) a first nucleic acid encoding said first monomer of claim 1 or 4;
   b) a second nucleic acid encoding said second monomer of claim 1 or 4; and
   c) a third nucleic acid encoding said light chain monomer of claim 1 or 4.

6. A host cell comprising a nucleic acid composition according to claim 5.

7. A method of making a composition comprising culturing the host cell of claim 6 under conditions where said nucleic acids are expressed and recovering said composition.

* * * * *